United States Patent
Abudayyeh et al.

(10) Patent No.: US 12,203,145 B2
(45) Date of Patent: Jan. 21, 2025

(54) CRISPR EFFECTOR SYSTEM BASED DIAGNOSTICS FOR VIRUS DETECTION

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Omar Abudayyeh, Cambridge, MA (US); James Joseph Collins, Cambridge, MA (US); Jonathan Gootenberg, Cambridge, MA (US); Feng Zhang, Cambridge, MA (US); Eric S. Lander, Cambridge, MA (US); Pardis Sabeti, Cambridge, MA (US); Catherine Amanda Freije, Cambridge, MA (US); Cameron Myhrvold, Cambridge, MA (US)

(73) Assignees: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

( * ) Notice: Subject to any disclaimer, the term of this patent is extended or adjusted under 35 U.S.C. 154(b) by 587 days.

(21) Appl. No.: 16/494,279

(22) PCT Filed: Mar. 15, 2018

(86) PCT No.: PCT/US2018/022764
§ 371 (c)(1),
(2) Date: Sep. 13, 2019

(87) PCT Pub. No.: WO2018/170340
PCT Pub. Date: Sep. 20, 2018

(65) Prior Publication Data
US 2020/0181720 A1    Jun. 11, 2020

Related U.S. Application Data

(60) Provisional application No. 62/471,931, filed on Mar. 15, 2017, provisional application No. 62/484,857, filed on Apr. 12, 2017, provisional application No. 62/530,086, filed on Jul. 7, 2017, provisional application No. 62/568,315, filed on Oct. 5, 2017, provisional application No. 62/588,138, filed on Nov. 17, 2017, provisional application No. 62/596,735, filed on Dec. 8, 2017.

(51) Int. Cl.
C12N 15/115    (2010.01)
C12Q 1/6851    (2018.01)
C12Q 1/70      (2006.01)

(52) U.S. Cl.
CPC .............. *C12Q 1/70* (2013.01); *C12N 15/115* (2013.01); *C12Q 1/6851* (2013.01); *C12N 2310/16* (2013.01); *C12N 2310/20* (2017.05); *C12Q 2521/301* (2013.01)

(58) Field of Classification Search
None
See application file for complete search history.

(56) References Cited

U.S. PATENT DOCUMENTS

| | | |
|---|---|---|
| 6,465,177 B1 | 10/2002 | Hoon et al. |
| 7,057,026 B2 | 6/2006 | Barnes et al. |
| 7,211,414 B2 | 5/2007 | Hardin et al. |
| 7,315,019 B2 | 1/2008 | Turner et al. |
| 7,329,492 B2 | 2/2008 | Jardin et al. |
| 7,405,281 B2 | 7/2008 | Xu et al. |
| 9,470,699 B2 | 10/2016 | Peeters |
| 10,266,886 B2* | 4/2019 | Abudayyeh .......... C12Q 1/6869 |
| 10,266,887 B2* | 4/2019 | Abudayyeh ............. C12P 19/34 |
| 11,371,081 B2* | 6/2022 | Green ...................... C12Q 1/70 |

(Continued)

FOREIGN PATENT DOCUMENTS

| | | |
|---|---|---|
| CN | 110506128 A | 11/2019 |
| JP | 2003-525037 A | 8/2003 |

(Continued)

OTHER PUBLICATIONS

Muller et al. Emerging infectious diseases Letters vol. 22, pp. 1685-1687 (Year: 2016).*

(Continued)

*Primary Examiner* — Brian Whiteman
(74) *Attorney, Agent, or Firm* — F. Brent Nix, Esq.; Johnson, Marcou, Isaacs & Nix, LLC

(57) ABSTRACT

Provided herein is a nucleic acid detection system comprising: a CRISPR system comprising an effector protein and one or more guide RNAs designed to bind to corresponding target molecules; an RNA-based masking construct; and optionally, nucleic acid amplification reagents to amplify target RNA molecules in a sample. In another aspect, the embodiments provide a polypeptide detection system comprising: a CRISPR system comprising an effector protein and one or more guide RNAs designed to bind a trigger RNA, an RNA-based masking construct; and one or more detection aptamers comprising a masked RNA polymerase promoter binding site or a masked primer binding site. In some embodiments, the system may be used to detect viruses in samples.

30 Claims, 135 Drawing Sheets
Specification includes a Sequence Listing.

(56) References Cited

U.S. PATENT DOCUMENTS

| | | | |
|---|---|---|---|
| 11,453,907 B2* | 9/2022 | Zhang | B01L 3/502715 |
| 11,584,955 B2* | 2/2023 | Wang | C12Q 1/6823 |
| 2002/0142291 A1* | 10/2002 | Bauer | G01N 33/558 435/7.1 |
| 2004/0171156 A1 | 9/2004 | Hartley et al. | |
| 2005/0069931 A1 | 3/2005 | Allis et al. | |
| 2006/0166239 A1 | 7/2006 | Chen et al. | |
| 2007/0243549 A1 | 10/2007 | Bischoff | |
| 2008/0108082 A1 | 5/2008 | Rank et al. | |
| 2009/0269745 A1 | 10/2009 | Tonoike et al. | |
| 2010/0240054 A1 | 9/2010 | Bischoff | |
| 2011/0111517 A1 | 5/2011 | Siegel et al. | |
| 2011/0265198 A1 | 10/2011 | Gregory et al. | |
| 2012/0017290 A1 | 1/2012 | Cui et al. | |
| 2012/0035065 A1 | 2/2012 | Smolke et al. | |
| 2012/0238008 A1 | 9/2012 | Henry et al. | |
| 2013/0190196 A1 | 7/2013 | Onderdonk et al. | |
| 2013/0236946 A1 | 9/2013 | Gouble | |
| 2014/0206014 A1 | 7/2014 | Micallef | |
| 2014/0356867 A1 | 12/2014 | Peter | |
| 2015/0065821 A1 | 3/2015 | Conrad | |
| 2015/0152398 A1* | 6/2015 | Doudna | C12N 9/22 435/254.11 |
| 2015/0342509 A1 | 12/2015 | Peeters et al. | |
| 2016/0161413 A1 | 6/2016 | Ing et al. | |
| 2016/0175462 A1 | 6/2016 | Zhang et al. | |
| 2017/0029872 A1 | 2/2017 | Bhattacharyya et al. | |
| 2017/0152553 A1* | 6/2017 | Ismagilov | C12Q 1/707 |
| 2017/0211142 A1* | 7/2017 | Smargon | C12N 15/111 |
| 2017/0321198 A1* | 11/2017 | Severinov | C12N 9/22 |
| 2017/0327911 A1* | 11/2017 | Peters | C12Q 1/6865 |
| 2017/0362644 A1* | 12/2017 | Doudna | C12Q 1/6823 |
| 2018/0002736 A1* | 1/2018 | O'Connell | C12Q 1/6818 |
| 2018/0150597 A1* | 5/2018 | Berthoumieux | G16B 20/20 |

FOREIGN PATENT DOCUMENTS

| | | |
|---|---|---|
| JP | 2013-505723 A | 2/2013 |
| JP | 2004-513617 A | 5/2014 |
| JP | 2014522646 A | 9/2014 |
| JP | 2015100332 A | 6/2015 |
| JP | 2019-522472 A | 8/2019 |
| JP | 2020-0501546 A | 1/2020 |
| WO | 91/06678 A1 | 5/1991 |
| WO | 01/59103 A2 | 8/2001 |
| WO | 02/000938 A2 | 1/2002 |
| WO | 2007/052765 A1 | 5/2007 |
| WO | 2007/123744 A2 | 11/2007 |
| WO | 2011/038197 A1 | 3/2011 |
| WO | 2011/109762 A1 | 9/2011 |
| WO | 2013/006973 A2 | 1/2013 |
| WO | 2013/071301 A1 | 5/2013 |
| WO | 2014/047561 A1 | 3/2014 |
| WO | 2014/093622 A2 | 6/2014 |
| WO | 2015/085194 A1 | 6/2015 |
| WO | 2016/060730 A1 | 4/2016 |
| WO | 2016/100975 A1 | 6/2016 |
| WO | 2016/172598 A1 | 10/2016 |
| WO | 2016/187508 A2 | 11/2016 |
| WO | 2017/004153 A1 | 1/2017 |
| WO | 2017/040316 A1 | 3/2017 |
| WO | 2017/047193 A1 | 3/2017 |
| WO | 2017/070605 A1 | 4/2017 |
| WO | 2017/075292 A1 | 5/2017 |
| WO | 2017/218573 A1 | 12/2017 |
| WO | 2018107129 A1 | 6/2018 |
| WO | 2018170340 A1 | 9/2018 |
| WO | 2020186223 A1 | 9/2020 |

OTHER PUBLICATIONS

Thatcher Clinical Chemistry 61: 1, pp. 89-99 (Year: 2015).*
Galil et al. Applied and Environmental Microbiology vol. 71 p. 7113-7116 (Year: 2005).*
Andries, et al., "Value of Routine Dengue Diagnostic Tests in Urine and Saliva Specimens," PLOS Neglected Tropical Diseases, vol. 9, No. 9, Sep. 25, 2015, all enclosed pages cited.
Faye, et al., "Quantitative real-time PCT detection of Zika Virus and Evaluation with Field-Caught Mosquitos," Virology Journal, vol. 10, No. 1, Oct. 22, 2013, all enclosed pages cited.
Li, et al., "CRISPR-Cas12a-Assisted Nucleic acid detection," Cell Discovery, vol. 4, No. 1, Apr. 24, 2018, all enclosed pages cited.
Myhrvold, et al., "Field-Deployable Viral Diagnostics Using CRISPR-Cas13," Science, vol. 360, No. 6387, Apr. 27, 2018, all enclosed pages cited.
Extended Search Report and Written Opinion for corresponding European application No. 18768160.6 mailed Dec. 1, 2020, all enclosed pages cited.
Zhao, et al., "Signal Amplification of Glucosamine-6-Phosphate Based on Ribozyme GlmS", Biosensors and Bioelectronics, vol. 62, Dec. 15, 2014, 337-342.
Kim, et al., "SNP Genotyping: Technologies and Biomedical Applications", Annual Review of Biomedical Engineering, vol. 9, 2007, 289-320.
Kovacs, et al., "Diagnosis of Pneumocystis Carinii Pneumonia: Improved Detection in Sputum with Use of Monoclonal Antibodies", New England Journal of Medicine, vol. 318, No. 10, Mar. 10, 1988, 589-593.
Kuntzen, et al., "Naturally Occurring Dominant Resistance Mutations to Hepatitis C Virus Protease and Polymerase Inhibitors in Treatment-Naïve Patients", Hepatology, vol. 48, No. 6, Dec. 2008, 1769-1778.
Kuroi, et al., "Clinical Significance of Plasma Nucleosome Levels in Cancer Patients", International Journal of Oncology, vol. 19, No. 1, Jul. 1, 2001, 143-148.
Kuroi, et al., "Plasma Nucleosome Levels in Node-Negative Breast Cancer Patients", Breast Cancer, vol. 6, No. 4, Oct. 4, 1999, 361-364.
Lambeth, et al., "Flow Cytometry-Based Assay for Titrating Dengue Virus", Journal of Clinical Microbiology, vol. 43, No. 7, Jul. 1, 2005, 3267-3272.
Lanciotti, et al., "Phylogeny of Zika Virus in Western Hemisphere, 2015", Emerging Infectious Diseases, vol. 22, No. 5, May 2016, 933-935.
Landau, et al., "Clonal Evolution in Hematological Malignancies and Therapeutic Implications", Leukemia, vol. 28, No. 1, Jan. 2014, 34-43.
Landau, et al., "Evolution and Impact of Subclonal Mutations in Chronic Lymphocytic Leukemia", Cell, vol. 152, No. 4, Feb. 14, 2013, 714-726.
Landau, et al., "Mutations Driving CLL and Their Evolution in Progression and Relapse", Nature, vol. 526, No. 7574, Oct. 22, 2015, 525-530.
Litin, "Current Concepts in Anticoagulant Therapy", Mayo Clinic Proceedings, vol. 70, No. 3, Mar. 1995, 266-272.
Lopez, et al., "Early Steps in Rotavirus Cell Entry", Reoviruses: Entry, Assembly and Morphogenesis, vol. 309, 2006, 39-66.
Lu, et al., "Advancing Bacteriophage-Based Microbial Diagnostics With Synthetic Biology", Trends in Biotechnology, vol. 31, No. 6, Jun. 2013, 325-327.
Maheswaran, et al., "Detection of Mutations in EGFR in Circulating Lung-Cancer Cells", The New England Journal of Medicine, vol. 359, No. 4, Jul. 24, 2008, 366-377.
Matranga, et al., "Enhanced Methods for Unbiased Deep Sequencing of Lassa and Ebola RNA Viruses from Clinical and Biological Samples", Genome Biology, vol. 15, No. 11, 2014, 12 pages.
Mcmillen, et al., "Inhibition of Influenza A Virus Matrix and Nonstructural Gene Expression Using RNA Interference", Virology, vol. 497, Oct. 2016, 171-184.
Medina, et al., "Influenza A Viruses: New Research Developments", Nature Reviews Microbiology, vol. 9, No. 8, Jul. 11, 2011, 590-603.
Metsky, et al., "Zika Virus Evolution and Spread in the Americas", Nature, vol. 546, No. 7658, Jun. 15, 2010, 411-415.
Miner, et al., "Zika Virus Pathogenesis and Tissue Tropism", Cell Host & Microbe, vol. 21, No. 2, Feb. 8, 2017, 134-142.

(56) References Cited

OTHER PUBLICATIONS

Miozzo, et al., "Microsatellite Alterations in Bronchial and Sputum Specimens of Lung Cancer Patients", Cancer Research, vol. 56, May 15, 1996, 2285-2288.
Momburg, et al., "Immunohistochemical Study of the Expression of a Mr 34,000 Human Epithelium-Specific Surface Glycoprotein in Normal and Malignant Tissues", Cancer Research, vol. 47, No. 11, Jun. 1, 1987, 2883-2891.
Mostert, et al., "Circulating Tumor Cells (CTCs): Detection Methods and Their Clinical Relevance in Breast Cancer", Cancer Treatment Reviews, vol. 35, No. 5, Aug. 2009, 463-474.
Nadal, et al., "A Novel Serum 4-microRNA Signature for Lung Cancer Detection", Scientific Reports, vol. 5, No. 12464, 2015, 9 pages.
Nagrath, et al., "Isolation of Rare Circulating Tumour Cells in Cancer Patients by Microchip Technology", Nature, vol. 450, No. 7173, Dec. 20, 2007, 1235-1239.
Nakamura, et al., "Codon Usage Tabulated from the International DNA Sequence Databases: Status for the Year 2000", Nucleic Acids Research, vol. 28, No. 1, Jan. 1, 2000, 1 page.
Ngaosuwankul, et al., "Influenza A Viral Loads in Respiratory Samples Collected from Patients Infected with Pandemic H1N1, Seasonal H1N1 and H3N2 Viruses", Virology Journal, vol. 7, No. 75, 2010, 8 pages.
Ngo, et al., "Identification and Mechanism of Action of a Novel Small-Molecule Inhibitor of Arenavirus Multiplication", Journal on Virology, vol. 89, No. 21, Nov. 2015, 10924-10933.
Ognibene, et al., "The Diagnosis of Pneumocystis Carinii Pneumonia in Patients with the Acquired Immunodeficiency Syndrome Using Subsegmental Bronchoalveolar Lavage", American Review of Respiratory Disease, vol. 129, No. 6, Jun. 1, 1984, 929-932.
Pardee, et al., "Paper-based Synthetic Gene Networks", Cell, vol. 159, No. 4, 2014, 950-954.
Pardee, et al., "Rapid, Low-Cost Detection of Zika Virus Using Programmable Biomolecular Components", Cell, vol. 165, No. 5, May 19, 2016, 1255-1266.
Park, et al., "Ebola Virus Epidemiology, Transmission, and Evolution during Seven Months in Sierra Leone", Cell, vol. 161, No. 7, Jun. 18, 2015, 1516-1526.
Paz-Bailey, et al., "Persistence of Zika Virus in Body Fluids—Final Report.", The New England Journal of Medicine, vol. 379, No. 13, Sep. 27, 2018, 1234-1243.
Pearson, et al., "On the Primer Selection Problem in Polymerase Chain Reaction Experiments", Discrete Applied Mathematics, vol. 71, 1996, 231-246.
Peng, et al., "An Archaeal CRISPR Type III-B System Exhibiting Distinctive RNA Targeting Features and Mediating Dual RNA and DNA Interference", Nucleic Acids Research, vol. 43, No. 1, Jan. 2015, 406-417.
Petersen, et al., "Drug-Resistant Malaria: Molecular Mechanisms and Implications for Public Health", FEBS Letters, vol. 585, No. 11, Jun. 6, 2011, 1551-1562.
Pfeifer, et al., "A Single Mutation in Poliovirus RNA-dependent RNA Polymerase Confers Resistance to Mutagenic Nucleotide Analogs via Increased Fidelity", Proceedings of the National Academy of Sciences of the United States of America, vol. 100, No. 12, Jun. 10, 2003, 7289-7294.
Pfeiffer, et al., "Ribavirin Resistance in Hepatitis C Virus Replicon-Containing Cell Lines Conferred by Changes in the Cell Line or Mutations in the Replicon RNA", Journal of Virology, vol. 79, No. 4, Feb. 2005, 2346-2355.
Phillippy, et al., "Efficient Oligonucleotide Probe Selection for Pan-Genomic Tiling Arrays", BMC Bioinformatics, vol. 10, No. 293, Sep. 16, 2009, 14 pages.
Piepenburg, et al., "DNA Detection Using Recombination Proteins", PLOS Biology, Jun. 13, 2006, 7 pages.
Platt, "CRISPR-Cas9 Knockin Mice for Genome Editing and Cancer Modeling", Cell, vol. 159, No. 2, Oct. 9, 2014, 440-455.
Priyamvada, et al., "Human Antibody Responses After Dengue Virus Infection are Highly Cross-Reactive to Zika Virus", Proceedings of the National Academy of Sciences of the United States of America, vol. 113, No. 28, Jul. 12, 2016, 7852-7857.
Requena-Castro, et al., "Molecular Detection of Mixed Infections with Multiple Dengue Virus Serotypes in Suspected Dengue Samples in Tamaulipas, Mexico", Memórias do Instituto Oswaldo Cruz, vol. 112, No. 7, 2017, 520-522.
Rhee, et al., "Human Immunodeficiency Virus Reverse Transcriptase and Protease Sequence Database", Nucleic Acids Research, vol. 31, No. 1, Jan. 1, 2003, 298-303.
Rooney, et al., "Molecular and Genetic Properties of Tumors Associated with Local Immune Cytolytic Activity", Cell, vol. 160, No. 1-2, Jan. 15, 2015, 27 pages.
Ross, et al., "Detection and Viability of Tumor Cells in Peripheral Blood Stem Cell Collections from Breast Cancer Patients using Immunocytochemical and Clonogenic Assay Techniques", Blood, vol. 82, No. 9, Nov. 10, 1993, 2605-2610.
Rouleau, et al., "Alteration in a New Gene Encoding a Putative Membrane-Organizing Protein Causes Neuro-Fibromatosis Type 2", Nature, vol. 363, No. 6429, Jun. 10, 1993, 515-521.
Rusdiana, et al., "Responsiveness to Low-Dose Warfarin Associated with Genetic Variants of VKORC1, CYP2C9, CYP2C19, and CYP4F2 in an Indonesian Population", European Journal of Clinical Pharmacology, vol. 69, No. 3, Mar. 2013, 395-405.
Samai, et al., "Co-Transcriptional DNA and RNA Cleavage During Type III CRISPR-Cas Immunity", Cell, vol. 161, No. 5, May 21, 2015, 1164-1174.
Sanjuan, et al., "Viral Mutation Rates", Journal on Virology, vol. 84, 2010, 9733-9784.
East-Seletsky, A., et al., Nature, (2016), vol. 538, pp. 270-273, Methods, Extended Data, all enclosed pages cited.
Abudayyeh O. O. et al., Science, (2016), vol. 353 Issue 6299, p. 557, aaf5573-1-9, Supplementary Material, all enclosed pages cited.
Gootenberg J. S. et al., Science, Apr. 13, 2017, 356, pp. 438-442, Supplementary Materials, all enclosed pages cited.
Notice of Rejection in corresponding Japanese application No. 2019-551300 mailed Jan. 25, 2022, all enclosed pages cited.
Examination report in corresponding Euroopean application No. 18768160.6 mailed Feb. 15, 2022, all enclosed pages cited.
Office Action for corresponding Saudi Arabian application No. 519410124 mailed Dec. 15, 2021, all enclosed pages cited.
International Search Report and Written Opinion for PCT Application No. PCT/US18/22764, mailed on Jul. 23, 2018, 39 pages.
Abudayyeh, et al., "C2c2 is a Single-Component Programmable RNA-Guided RNA-Targeting CRISPR Effector", Science, vol. 353, No. 6299, Aug. 5, 2016, 11 pages.
Allard, et al., "Tumor Cells Circulate in the Peripheral Blood of all Major Carcinomas but not in Healthy Subjects or Patients with Nonmalignant Diseases", Clinical Cancer Research, vol. 10, No. 20, Oct. 15, 2004, 6897-6904.
Amoura, et al., "Circulating Plasma Levels of Nucleosomes in Patients with Systemic Lupus Erythematosus", Arthritis & Rheumatism, vol. 40, No. 12, Dec. 1997, 2217-2225.
Andersen, et al., "Clinical Sequencing Uncovers Origins and Evolution of Lassa Virus", Cell, vol. 162, No. 4, Aug. 13, 2015, 738-750.
Andries, et al., "Value of Routine Dengue Diagnostic Tests in Urine and Saliva Specimens", PLOS Neglected Tropical Diseases, vol. 9, No. 9, Sep. 25, 2015, 30 pages.
Balmaseda, et al., "Antibody-Based Assay Discriminates Zika Virus Infection From Other Flaviviruses", Proceedings of the National Academy of Sciences of the United States of America, vol. 114, No. 31, Aug. 1, 2017, 8384-8389.
Bentley, et al., "Accurate Whole Human Genome Sequencing using Reversible Terminator Chemistry", Nature, vol. 456, No. 7218, Nov. 6, 2008, 53-59.
Bhagat, et al., "Dean Flow Fractionation (DFF) Isolation of Circulating Tumor Cells (CTCs) from Blood", 15th International Conference on Miniaturized Systems for Chemistry and Life Sciences, Oct. 2011, 524-526.
Zeng, et al., "Ribavirin-Resistant Variants of Foot-and-Mouth Disease Virus: the Effect of Restricted Quasispecies Diversity on Viral Virulence", Journal of Virology, vol. 88, No. 8, Apr. 2014, 4008-4020.

(56) References Cited

OTHER PUBLICATIONS

Bosch, et al., "Rapid Antigen Tests for Dengue Virus Serotypes and Zika Virus in Patient Serum", Science Translational Medicine, vol. 9, Issue 409, Sep. 27, 2017, 15 pages.

Burger, et al., "Clonal Evolution in Patients with Chronic Lymphocytic Leukaemia Developing Resistance to BTK Inhibition", Nature Communications, vol. 7:11589, May 20, 2016, 13 pages.

Carr, et al., "Genome Engineering", Nature Biotechnology, vol. 27, No. 12, Dec. 2009, 1151-1162.

Chotiwan, et al., "Rapid and Specific Detection of Asian- and African-Lineage Zika Viruses", Science Translational Medicine, vol. 9, Issue 388, May 3, 2017, 15 pages.

Chung, et al., "Polycistronic RNA polymerase II Expression Vectors for RNA Interference Based on BIC/miR-155", Nucleic Acids Research, vol. 34, No. 7, e53, Apr. 13, 2006, 14 pages.

Cohen, et al., "Relationship of Circulating Tumor Cells to Tumor Response, Progression-Free Survival, and Overall Survival in Patients with Metastatic Colorectal Cancer", Journal of Clinical Oncology, vol. 26, No. 19, Jul. 1, 2008, 3213-3221.

Cong, et al., "Multiplex Genome Engineering Using CRISPR/Cas Systems", Science, vol. 339, No. 6121, 2013, 819-823.

Cristofanilli, et al., "Circulating Tumor Cells: A Novel Prognostic Factor for Newly Diagnosed Metastatic Breast Cancer", Journal of Clinical Oncology, vol. 23, No. 7, Mar. 1, 2005, 1420-1430.

Cristofanilli, et al., "Circulating Tumor Cells, Disease Progression, and Survival in Metastatic Breast Cancer", The New England Journal of Medicine, vol. 351, Aug. 19, 2004, 781-791.

Das, et al., "Ultra-Portable, Wireless Smartphone Spectrophotometer for Rapid, Non-Destructive Testing of Fruit Ripeness", Nature Scientific Reports, vol. 6, No. 32504, Sep. 2016, 8 pages.

De Bono, et al., "Circulating Tumor Cells Predict Survival Benefit from Treatment in Metastatic Castration-Resistant Prostate Cancer", Clinical Cancer Research, vol. 14, No. 19, Oct. 1, 2008, 6302-6309.

De Clercq, et al., "Approved Antiviral Drugs Over the Past 50 Years", Clinical Microbiology Reviews, vol. 29, No. 23, 2016, 695-747.

Diehl, et al., "Ebola Virus Glycoprotein with Increased Infectivity Dominated the 2013-2016 Epidemic", Cell, vol. 167, No. 4, Nov. 3, 2016, 1088-1098.

Dominguez, et al., "Beyond Editing: Repurposing CRISPR-Cas9 for Precision Genome Regulation and Interrogation", Nature Reviews Molecular Cell Biology, vol. 17, No. 1, Jan. 2016, 5-15.

Donald, et al., "Full Genome Sequence and sfRNA Interferon Antagonist Activity of Zika Virus from Recife, Brazil", PLOS Neglected Tropical Diseases, Oct. 5, 2016, 20 pages.

Du, et al., "Coupling Sensitive Nucleic Acid Amplification with Commercial Pregnancy Test Strips", Angewandte Chemie International Edition in English, vol. 56, No. 4, Jan. 19, 2019, 992-996.

Duitama, et al., "PrimerHunter: A Primer Design Tool for PCR-Based Virus Subtype Identification", Nucleic Acids Research, vol. 37, No. 8, May 2009, 2483-2492.

East-Seletsky, et al., "Two Distinct RNase Activities of CRISPR-C2c2 Enable Guide-RNA Processing and RNA Detection", Nature, vol. 538, No. 7624, Oct. 13, 2016, 17 pages.

Eboigbodin, et al., "Rapid Molecular Diagnostic Test for Zika Virus with Low Demands on Sample Preparation and Instrumentation", Diagnostic Microbiology and Infectious Disease, vol. 86, No. 4, Dec. 2016, 369-371.

Faye, et al., "One-Step RT-PCR For Detection of Zika Virus", Journal of Clinical Virology, vol. 43, No. 1, Sep. 2008, 96-101.

Flipse, et al., "Dengue Tropism for Macrophages and Dendritic Cells: The Host Cell Effect", Journal of General Virology, vol. 97, Issue 7, Feb. 28, 2016, 1531-1536.

Ghany, et al., "Antiviral Resistance and Hepatitis B Therapy", Hepatolgy, vol. 49, No. 5, Apr. 27, 2009, S174-S184.

Gire, et al., "Genomic Surveillance Elucidates Ebola Virus Origin and Transmission During the 2014 Outbreak", Science, vol. 345, No. 6202, Sep. 12, 2014, 1369-1372.

Gootenberg, et al., "Multiplexed and Portable Nucleic Acid Detection Platform with Cas13, Cas12a, and Csm6", Science, vol. 360, No. 6387, Feb. 15, 2018, 439-444.

Gootenberg, et al., "Nucleic Acid Detection with CRISPR-Cas13a/C2c2", Science, vol. 356, No. 6336, Apr. 28, 2017, 438-442.

Hahn, et al., "DPC4, A Candidate Tumor Suppressor Gene at Human Chromosome 18q21.1", Science, vol. 271, No. 5247, Jan. 19, 1996, 350-353.

Hale, et al., "RNA-Guided RNA Cleavage by a CRISPR RNA-Cas Protein Complex", Cell, vol. 139, No. 5, Nov. 25, 2009, 945-956.

Hale, et al., "Target RNA Capture and Cleavage by the Cmr Type III-B CRISPR-Cas Effector Complex", Genes & Development, vol. 28, No. 21, Sep. 29, 2014, 2432-2443.

Heider, et al., "DNA Watermarks: A Proof of Concept", BMC Molecular Biology, vol. 9, 2008, 40-50.

Hendel, et al., "Chemically Modified Guide RNAs Enhance CRISPR-Cas Genome Editing in Human Primary Cells", Nature Biotechnology, vol. 33, No. 9, Sep. 2015, 985-989.

Holdenrieder, et al., "Nucleosomes in Serum of Patients with Benign and Malignant Diseases", International Journal of Cancer, vol. 95, Feb. 28, 2001, 114-120.

Holford, "Clinical Pharmacokinetics and Pharmacodynamics of Warfarin Understanding the Dose-Effect Relationship", Clinical Pharmacokinetics, vol. 11, No. 6, Dec. 1986, 483-504.

Hou, et al., "Direct Dectection and Drug-Resistance Profiling of Bacteremias Using Inertial Microfluidics", Laboratory on a Chip, vol. 15, No. 10, May 21, 2015, 2297-2307.

Hou, et al., "Microfluidic Devices for Blood Fractionation", Micromachines, vol. 2, 2011, 319-343.

Huang, et al., "In Vivo Inhibition of Influenza A virus Replication by RNA Interference Targeting the PB2 Subunit via Intratracheal Delivery", PLoS One, vol. 12, No. 4, Apr. 5, 2017, 15 pages.

Hulo, et al., "ViralZone: A Knowledge Resource to Understand Virus Diversity", Nucleic Acids Research, vol. 39, Jan. 2011, 576-582.

Jabado, et al., "Comprehensive Viral Oligonucleotide Probe Design Using Conserved Protein Regions", Nucleic Acids Research, vol. 36, No. 1, 2008, 10 pages.

Jabado, et al., "Greene SCPrimer: A Rapid Comprehensive Tool for Designating Degenerate Primers from Multiple Sequence Alignments", Nucleic Acids Reseach, vol. 34, No. 22, Nov. 28, 2006, 6605-6611.

Jia, et al., "CARD 2017: Expansion and Model-Centric Curation of the Comprehensive Antibiotic Resistance Database", Nucleic Acids Research, vol. 45, Jan. 4, 2017, D566-D573.

Kamb, et al., "A Cell Cycle Regulator Potentially Involved in Genesis of Many Tumor Types", Science, vol. 264, No. 5157, Apr. 15, 1994, 436-440.

Zuker, et al., "Optimal Computer Folding of Large RNA Sequences Using Thermodynamics and Auxiliary Information", Nucleic Acids Research, vol. 9, No. 1, 1981, 133-148.

Schelhaas, et al., "Herpes Simplex Virus Type 1 Exhibits a Tropism for Basal Entry in Polarized Epithelial Cells", Journal of General Virology, vol. 84, No. 9, Sep. 1, 2003, 2473-2484.

Schieck, et al., "Hepatitis B virus Hepatotropism is Mediated by Specific Receptor Recognition in the Liver and not Restricted to Susceptible Hosts", Hepatology, vol. 58, No. 1, Jul. 2013, 43-53.

Schluger, et al., "Application of DNA Amplification to Pneumocystosis: Presence of Serum Pneumocystis Carinii DNA During Human and Experimentally Induced Pneumocystis Carinii Pneumonia", Journal of Experimental Medicine, vol. 176, No. 5, Nov. 1, 1992, 1327-1333.

Schoffner, et al., "Chip PCR. I. Surface Passivation of Microfabricated Silicon-Glass Chips for PCR", Nucleic Acids Research, vol. 24, No. 2, Jan. 1, 1996, 375-379.

Schwartz, et al., "Biology and Pathogenesis of Chikungunya Virus", Nature Reviews Microbiology, vol. 8, No. 7, Jul. 2010, 491-500.

Shafiee, et al., "Paper and Flexible Substrates as Materials for Biosensing Platforms to Detect Multiple Biotargets", Scientific Reports, vol. 5, No. 8719, Mar. 6, 2015, 1-9.

Shmakov, et al., "Discovery and Functional Characterization of Diverse Class 2 CRISPR-Cas Systems", Molecular Cell, vol. 60, No. 3, Nov. 5, 2015, 385-397.

(56) References Cited

OTHER PUBLICATIONS

Singer, et al., "A Distinct Gene Module for Dysfunction Uncoupled from Activation in Tumor-Infiltrating T Cells", Cell, vol. 166, No. 6, Sep. 8, 2016, 32 pages.

Smargon, et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 618-630.

St John, et al., "Existing and Emerging Technologies for Point-of-Care Testing", The Clinical Biochemist Reviews, vol. 35, No. 3, Aug. 2014, 155-167.

Steck, et al., "Identification of a Candidate Tumour Suppressor Gene, MMAC1, at Chromosome 10q23.3 that is Mutated in Multiple Advanced Cancers", Nature Genetics, vol. 15, No. 4, Apr. 1997, 356-362.

Stoppani, et al., "Expression of a Single siRNA Against a Conserved Region of NP Gene Strongly Inhibits in Vitro Replication of Different Influenza A Virus Strains of Avian and Swine Origin", Antiviral Research, vol. 120, 2015, 16-22.

Stroun, et al., "The Origin and Mechanism of Circulating DNA", Annals of the New York Academy of Sciences, vol. 906, Apr. 2000, 161-168.

Sullivan, et al., "Point Mutation in the Glycoprotein of Lymphocytic Choriomeningitis Virus is Necessary for Receptor Binding, Dendritic Cell Infection, and Long-term Persistence", Proceedings of the National Academy of Sciences of the United States of America, vol. 108, No. 7, Feb. 15, 2011, 2969-2974.

Talasaz, et al., "Isolating Highly Enriched Populations of Circulating Epithelial Cells and Other Rare Cells from Blood using a Magnetic Sweeper Device", Proceedings of the National Academy of Sciences, vol. 106, No. 10, Mar. 10, 2009, 3970-3975.

Tirosh, "Dissecting the Multicellular Ecosystem of Metastatic Melanoma by Single cell RNA-seq", Science, vol. 352, No. 6282, Apr. 8, 2016, 189-196.

Tirosh, et al., "Single-Cell RNA-seq Supports a Developmental Hierarchy in Human Oligodendroglioma", Nature, vol. 539, No. 7628, Nov. 10, 2016, 309-313.

Trejo-Becerril, et al., "Circulating Nucleosomes and Response to Chemotherapy: An in Vitro, in Vivo and Clinical Study on Cervical Cancer Patients", International Journal of Cancer, vol. 104, 2003, 663-668.

Urbanowicz, et al., "Human Adaptation of Ebola Virus during the West African Outbreak", Cell, vol. 167, Issue 4, Nov. 3, 2016, 1079-1087.

Van Ness, et al., "Isothermal Reactions for the Amplification of Oligonucleotides", Proceedings of the National Academy of Sciences of the United States of America, vol. 100, No. 8, Apr. 15, 2003, 4504-4509.

Vashist, et al., "Commercial Smartphone-Based Devices and Smart Applications for Personalized Healthcare Monitoring and Management", Diagnostics, vol. 4, No. 3, Aug. 14, 2014, 104-128.

Waggoner, et al., "Comparison of the FDA-Approved CDC DENV-1-4 Real-Time Reverse transcription-PCR with a Laboratory-Developed Assay for Dengue Virus Detection and Serotyping", Journal of Clinical Microbiology, vol. 51, No. 10, Jul. 31, 2013, 3418-3420.

Wahed, et al., "Recombinase Polymerase Amplification Assay for Rapid Diagnostics of Dengue Infection", PLOS One, Jun. 15, 2015, 17 pages.

Walker, et al., "Global Burden of Childhood Pneumonia and Diarrhoea", Lancet, vol. 381, No. 9875, Apr. 20, 2013, 1405-1416.

Wang, et al., "Flexible Substrate-Based Devices for Point-of-Care Diagnostics", Trends in Biotechnology, vol. 34, No. 11, Nov. 2016, 909-921.

Wang, et al., "Structure-Switching Aptamer Triggering Hybridization Chain Reaction on the Cell Surface for Activatable Theranostics", Analytical Chemistry, vol. 87, No. 13, Jun. 5, 2015, 6470-6474.

Wang, et al., "Targeted Disruption of Influenza A virus Hemagglutinin in Genetically Modified Mice Reduces Viral Replication and Improves Disease Outcome", Scientific Reports, vol. 6, No. 23746, 2016, 12 pages.

Wang, et al., "The Highly Pathogenic H5N1 Influenza A virus Down-Regulated Several Cellular MicroRNAs which Target Viral Genome", Journal of Cellular and Molecular Medicine, vol. 21, No. 11, Nov. 2017, 11 pages.

Weickmann, et al., "Human Ribonucleases. Quantitation of Pancreatic-like Enzymes in Serum, Urine, and Organ Preparations", The Journal of Biological Chemistry, vol. 257, No. 15, Aug. 10, 1982, 8705-8710.

Weiss, "HIV Receptors and Cellular Tropism", IUBMB Life, vol. 53, No. 4-5, Apr. 2002, 201-205.

WHO, "Artemisinin and Artemisinin-Based Combination Therapy Resistance", Status Report, Global Malaria Programme, World Health Organization, Apr. 2016, 12 pages.

WHO, "Guidelines for the Treatment of Malaria", World Health Organization, Third Edition, Apr. 2015, 317 pages.

WHO, "Susceptibility of Plasmodium Falciparum to Antimalarial Drugs", Report on Global Monitoring 1996-2004, 2005, 142 pages.

Zetsche, et al., "Cpf1 is a Single RNA-Guided Endonuclease of a Class 2 CRISPR-Cas System", Cell, vol. 163, No. 3, Oct. 22, 2015, 759-771.

Woolhouse, et al., "Temporal Trends in the Discovery of Human Viruses", Proceedings of the Royal Society B, vol. 275, No. 1647, May 27, 2008, 2111-2115.

Xu, et al., "RNA Interference of Influenza A Virus Replication by MicroRNA-Adapted Lentiviral Loop Short Hairpin RNA", Journal of General Virology, vol. 96, No. 10, Oct. 2015, 2971-2981.

Yan, et al., "Cas13d Is a Compact RNA-Targeting Type VI Crispr Effector Positively Modulated by a WYL-Domain-Containing Accessory Protein", Molecular Cell, vol. 70, No. 2, Apr. 19, 2018, 327-339.

Yang, et al., "Decay Rates of Human mRNAs: Correlation with Functional Characteristics and Sequence Attributes", Genome Research, vol. 13, No. 8, Aug. 2003, 1863-1872.

Ye, et al., "Primer-BLAST: A Tool to Design Target-Specific Primers for Polymerase Chain Reaction", BMC Bioinformatics, vol. 13, No. 134, 2012, 11 pages.

Yuan, et al., "A Single Mutation in the prM Protein of Zika Virus Contributes to Fetal Microcephaly", Science, vol. 358, Issue 6365, Nov. 17, 2017, 933-936.

Bigby, et al., "The Usefulness of Induced Sputum in the Diagnosis of Pneumocystis cairn Pneumonia in Patients with the Acquired Immunodeficiency Syndrome", American Review of Respiratory Disease, vol. 133, No. 4, Apr. 1, 1986, 515-518.

Williams, et al., "Detection of Nucleosome Particles in Serum and Plasma from Patients with Systemic Lupus Erythematosus using Monoclonal Antibody 4H7", The Journal of Rheumatology, vol. 28, No. 1, Jan. 2001, 81-94.

Office Action from corresponding Japanese application No. 2019-551300 mailed Aug. 23, 2022, all enclosed pages cited.

Office Action for corresponding Korean application No. 10-2019-7029824 mailed Jul. 11, 2022, all enclosed pages cited.

Office Action for corresponding Saudi Arabian application No. 519410124 mailed Aug. 2, 2022, all enclosed pages cited.

Office Action from corresponding Israeli application No. 269330 mailed Dec. 8, 2022, all enclosed pages cited.

Ou, et al., "Development of a lateral flow immunochromatographic assay for rapid detection of Mycoplasma pneumoniae-specific IgM in human serum specimens," Journal of Microbiological Methods 124 (2016) 35-40.

Office Action from corresponding Korean Application No. 10-2019-7029824 mailed Jun. 30, 2023, all enclosed pages cited.

Intent to Grant from corresponding European application No. 18768160.6 mailed Mar. 17, 2023, all enclosed pages cited.

Office Action from corresponding UAE application No. P6001323/2019 mailed Nov. 15, 2023, all enclosed pages cited.

Search Report from corresponding UAE application No. P6001323/2019 mailed Nov. 15, 2023, all enclosed pages cited.

Office Action from corresponding Japanese application No. 2022-206195 mailed Dec. 7, 2023, all enclosed pages cited.

(56) References Cited

OTHER PUBLICATIONS

Kellner, et al., "Sherlock: nucleic acid detection with CRISPR nucleases," Nature Protocols, Oct. 31, 2019, all enclosed pages cited.
Office Action from corresponding Chinese application No. 201880032672.7 mailed Jun. 27, 2023, all enclosed pages cited.
Search Report from corresponding Chinese application No. 201880032672.7 mailed Jun. 27, 2023, all enclosed pages cited.
Office Action from corresponding Canadian application No. 3,056,411 mailed Aug. 28, 2023, all enclosed pages cited.
Office Action from corresponding Australian application No. 2018234832 mailed Oct. 9, 2023, all enclosed pages cited.
Office Action from corresponding Korean application No. 10-2019-7029824 mailed Jan. 30, 2024, all enclosed pages cited.
Office Action from corresponding Chinese application No. 201880032672.7 mailed Jan. 15, 2024, all enclosed pages cited.
Tong, et al., "High-fidelity Cas13 variants for targeted RNA degradation with minimal collateral effect," https://doi.org/10.1101/2021.12.18.473271, Dec. 23, 2021, all enclosed pages cited.
Office Action from corresponding Chinese application No. 201880032672.7 mailed May 17, 2024, all enclosed pages cited.
Office Action from corresponding Japanese Application No. 2022-206195 mailed Jul. 2, 2024, all enclosed pages cited.

* cited by examiner

FIG. 3

This is C2c2 signal on paper for a 20pM target. Note that the freeze-drying before actually boosts signal (the right plot).

A
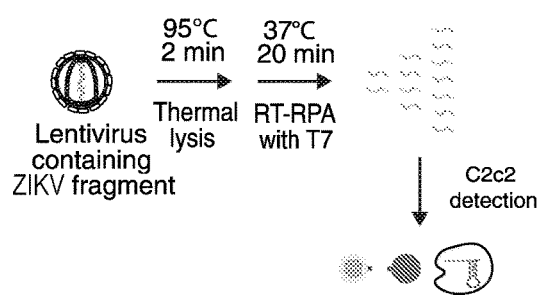
B
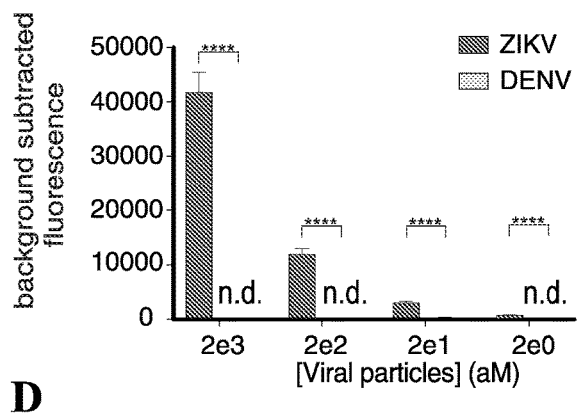
C
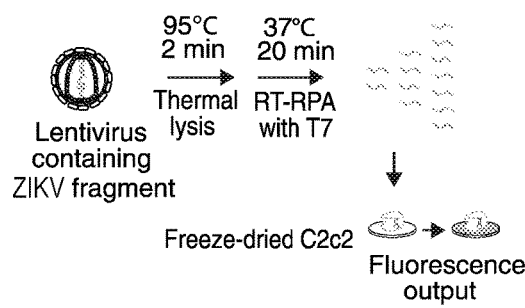
D
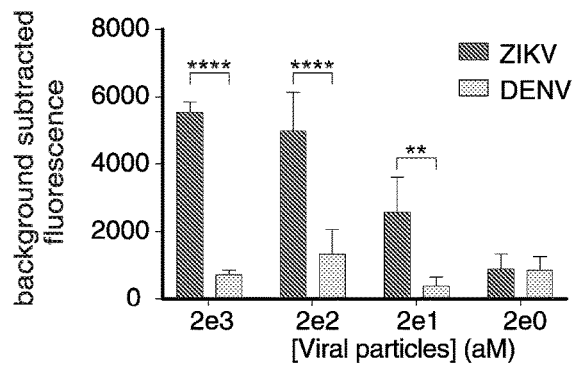
FIG. 31

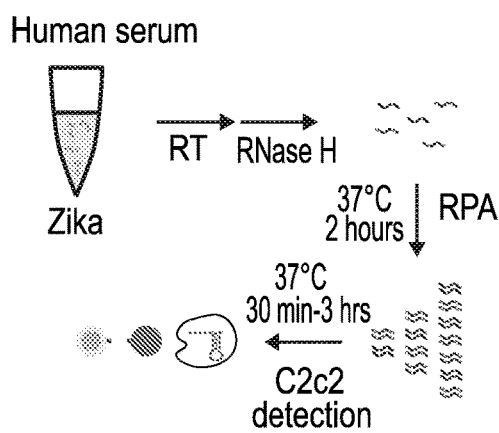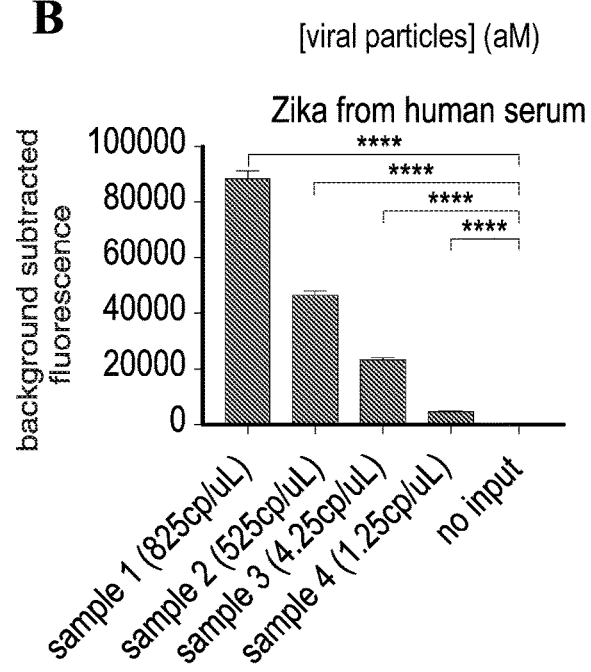
FIG. 32

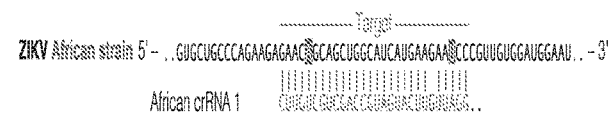
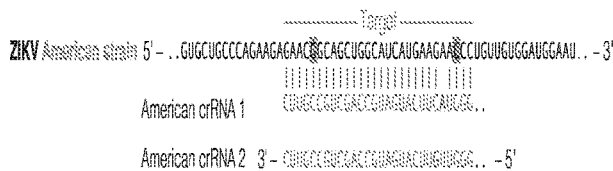
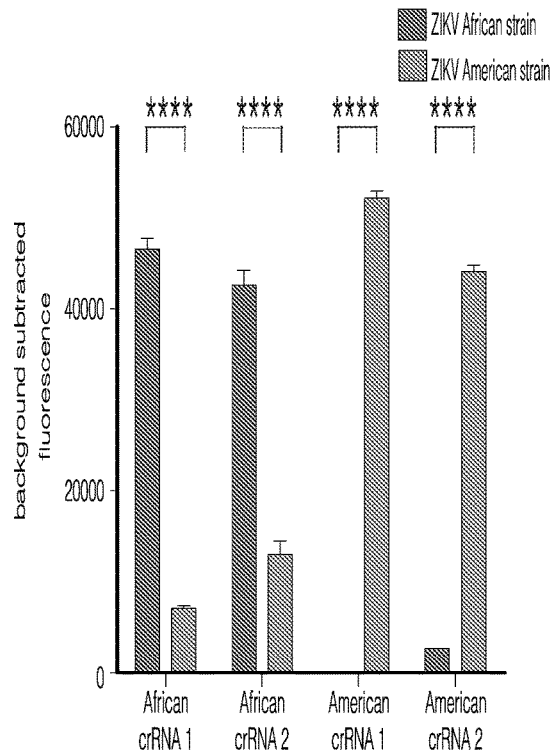
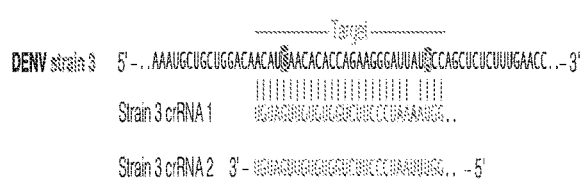
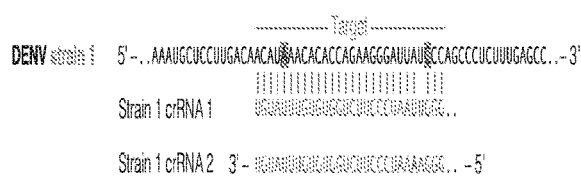
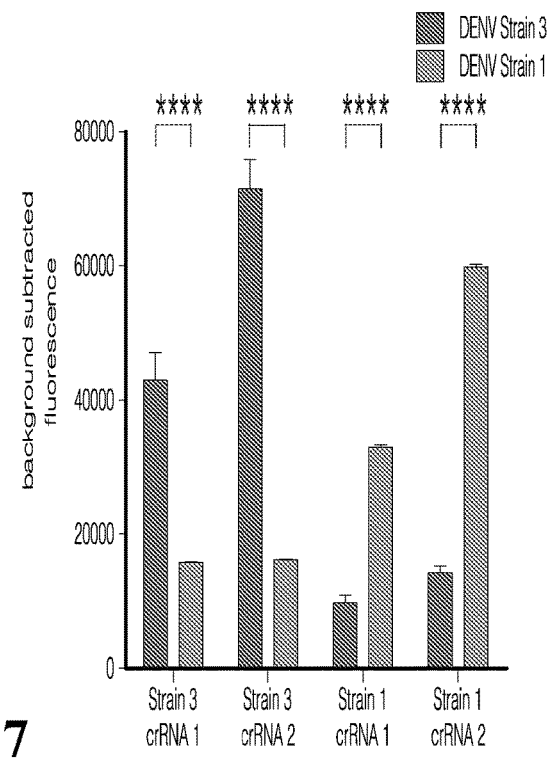
FIG. 37

A 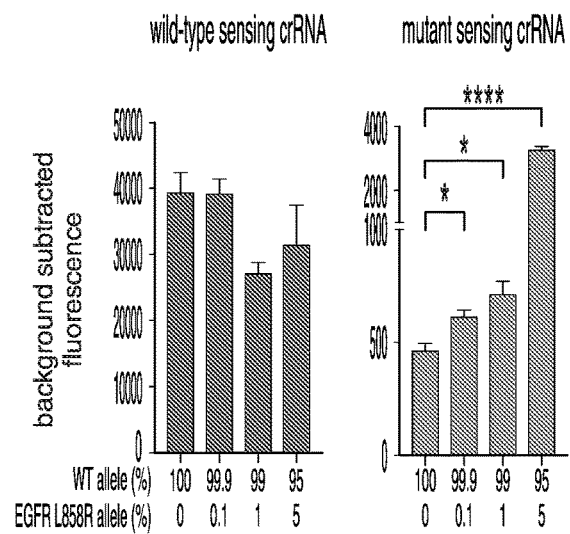
B 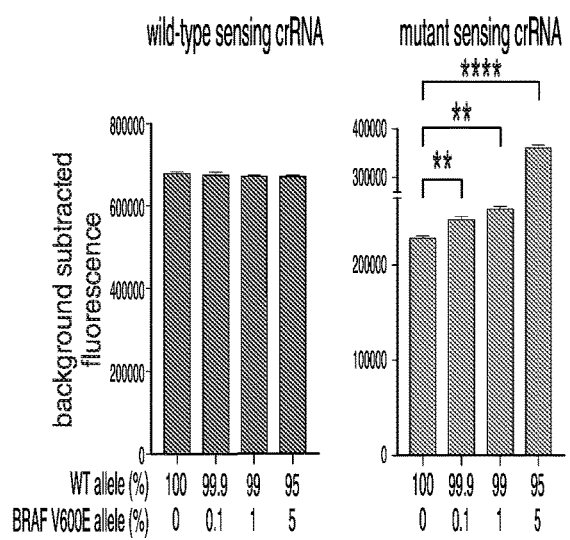
FIG. 39

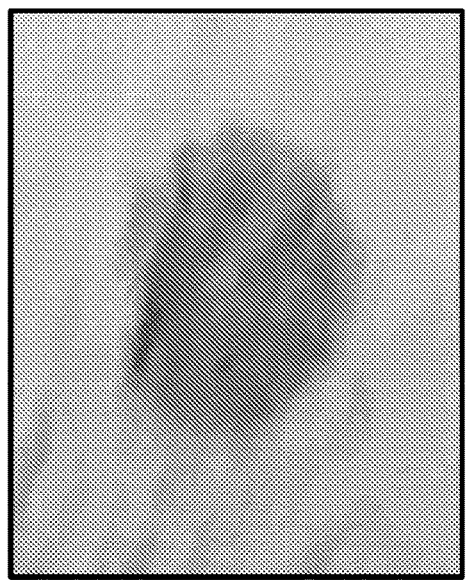 
30 units RNase A  no RNase A
FIG. 47

|  | 586　　　　　603 | 1276　　　1290 |
|---|---|---|
| c2c2_Leptotnchia shahii | IRKFTKIGTN ERNRILHA | SIRNYISHFYIVRNP |
| c2c2-5 Lachnospiraceae bacterium MA2020 | LYSLKSMLYS MRNSSFHF | IFRNEIDHFHYFYDR |
| c2c2-6 Lachnospiraceae | LTDLKDVIYS MRNDSFHY | ELRNYIEHFRYYSSF |
| c2c2-7 [Clostridium] ammophilum DSM 10710 | ADDLRKAIYS LRNETFHF | DVRKYVDHFKYYATS |
| c2c2-8 Camobacterium gallinarum DSM 4847 | IWALRGSVQQ IRNEIFHS | KIRNQTAHLSVLQLE |
| c2c2-9 Camobacterium gallinarum DSM 4847 | LWAIRGAVQR VRNQIFHQ | EIRNNIAHLHVLRND |
| c2c2-10 Paludibacter propionicigenes WB4 | LWGIRGAVQQ IRNNVNHY | DIRNHIAHFNYLTKD |
| c2c2-11 Listeria weihenstephanensis FSL R9-0317 | IWAIRGSIQQ IRNEVYHC | NARNHIAHLNYLSLK |
| c2c2-12 Listeriaceae bacterium FSL M6-0635 | IWAIRGSIQQ IRNEVYHC | NARNHIAHLNYLSLK |
| c2c2-13 Leptotrichia wadei F0279 | FANIDEAISS IRHGIVHF | YIRNYIAHFNYIPHA |
| c2c2-14 Rhodobacter capsulatus SB 1003 | VFALLRYLRG CRNQTFHL | QTRKDLAHFNVLDRA |
| c2c2-15 Rhodobacter capsulatus R121 | VFALLRYLRG CRNQTFHL | QTRKDLAHFNVLDRA |
| c2c2-16 Rhodobacter capsulatus DE442 | VFALLRYLRG CRNQTFHL | QTRKDLAHFNVLDRA |
| c2-3 L wadei (Lw2) | FANIDEAISS IRHGIVHF | YIRNYIAHFNYIPHA |
| c2-4 Listeria seeligeri | SWGLRGAIAP IRNEIIHL | EKRNNISHFNYLNGQ |
|  | ↑↑　↑ | ↑↑　↑ |

FIG. 50

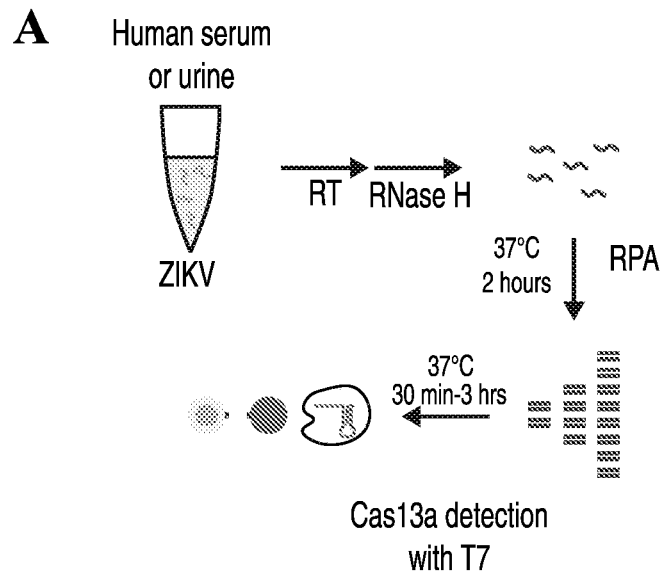
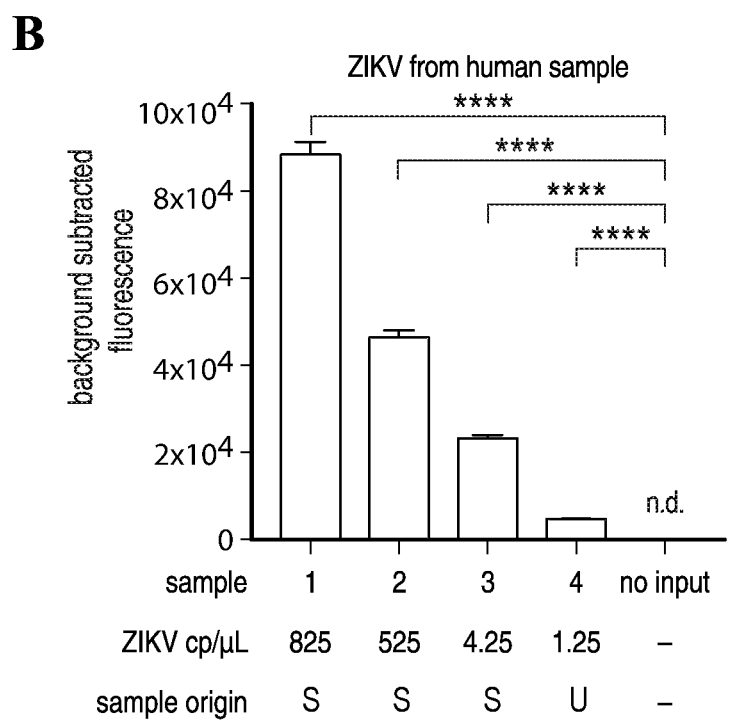
FIG. 52

A

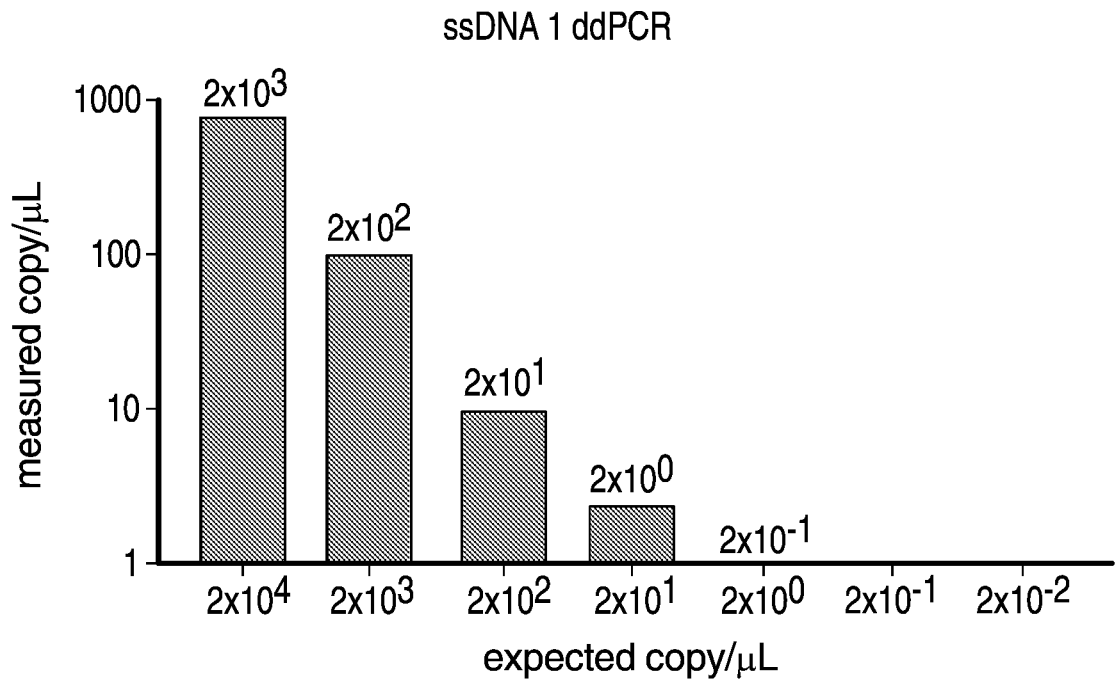
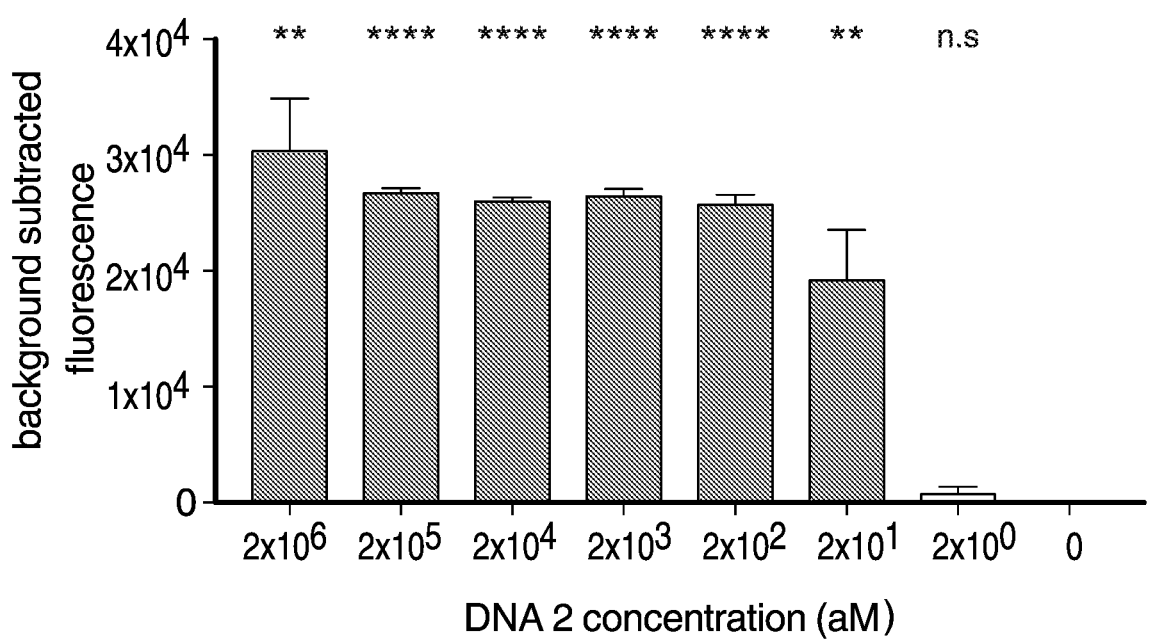
FIG. 54 (continued)

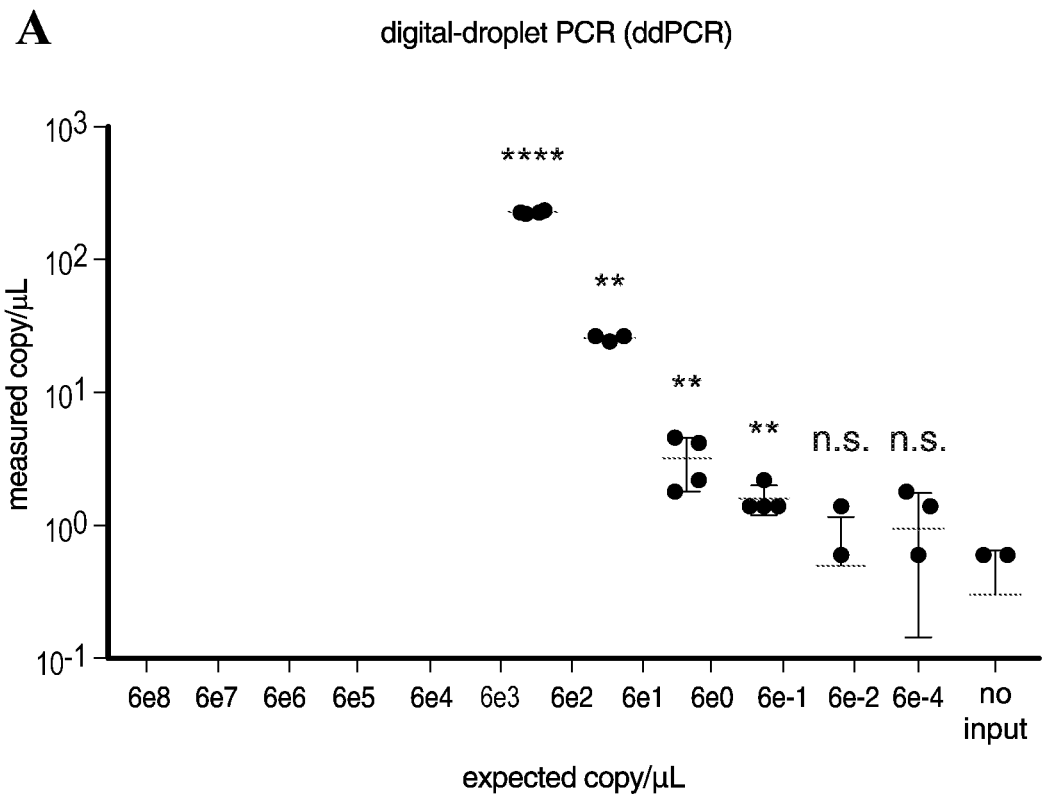
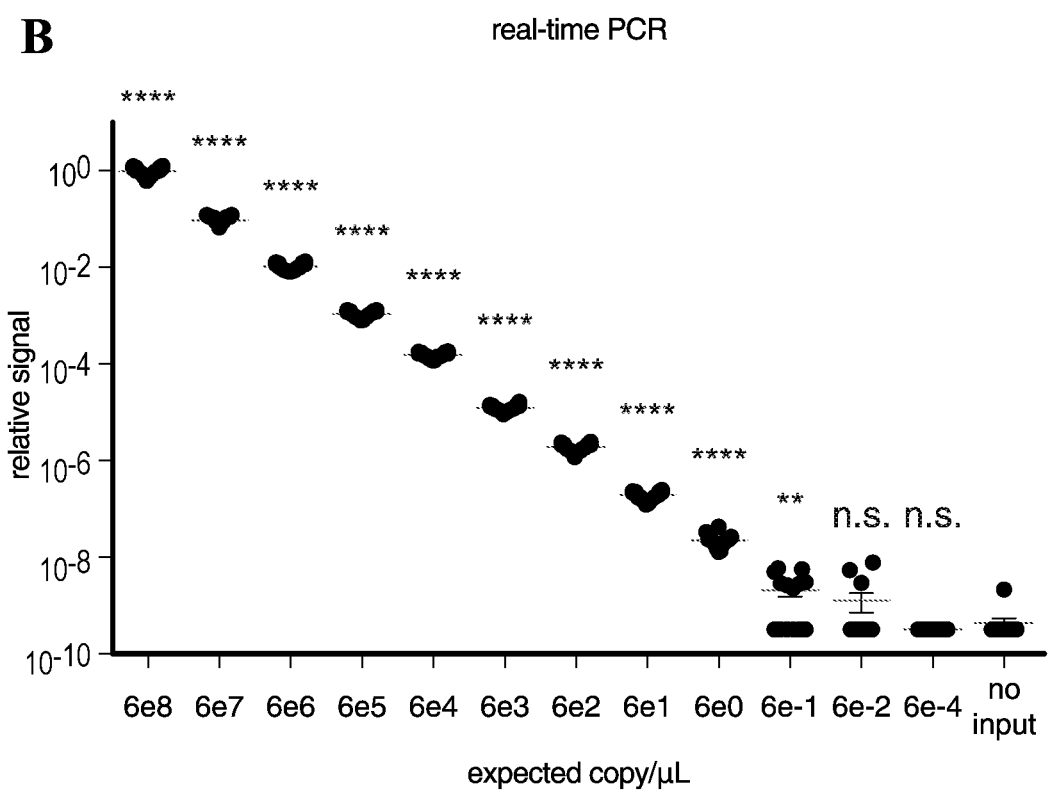
FIG. 55

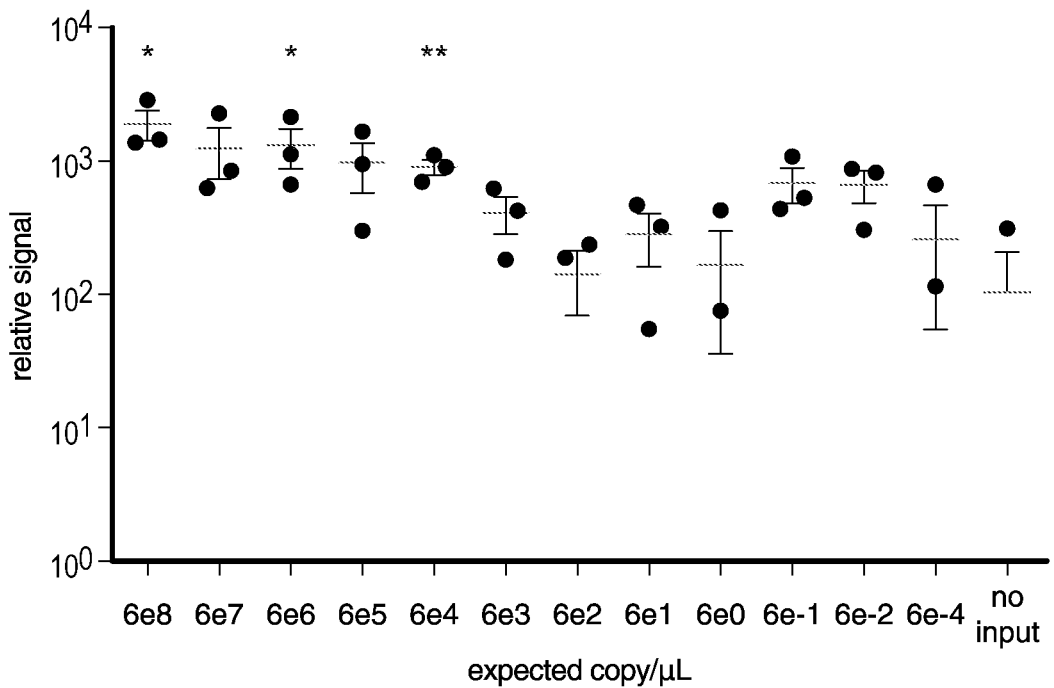
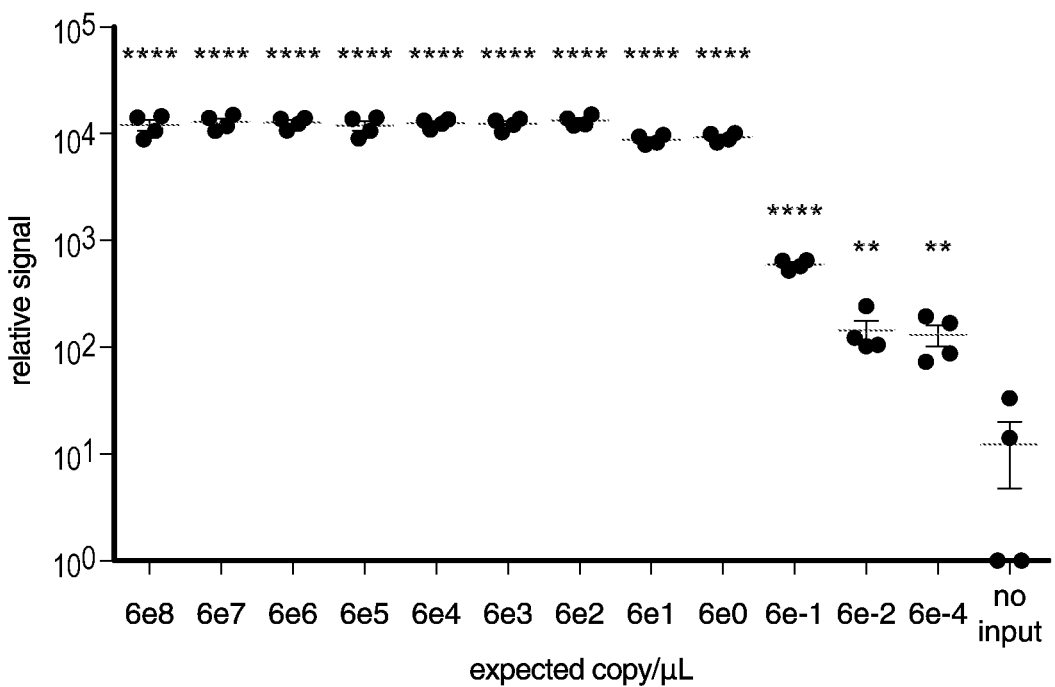
FIG. 55 (continued)

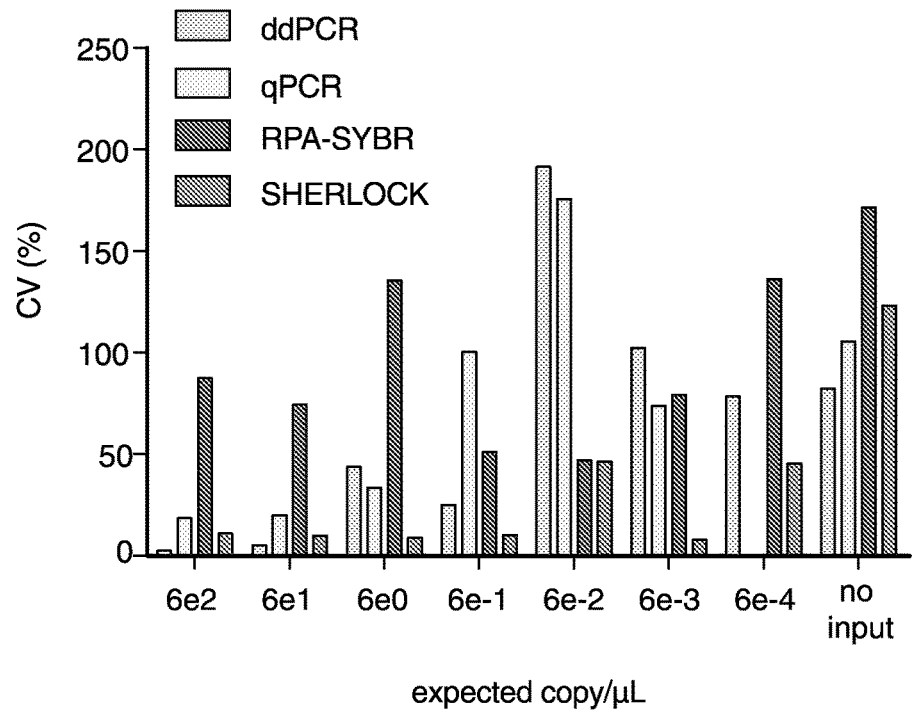
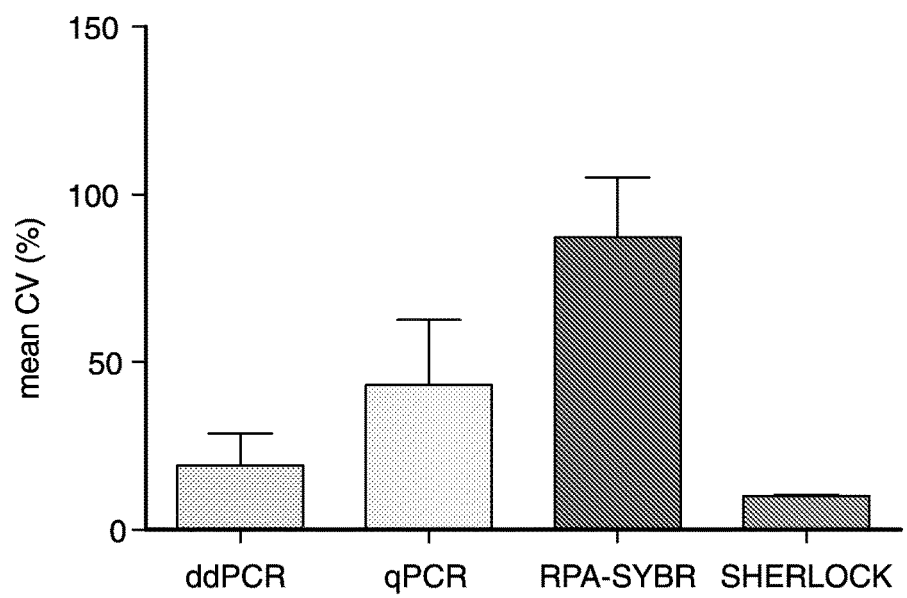
FIG. 55 (continued)

A

```
        UC
       A  A
  AAAACCCC GAUUUAG  -5'
 A        ||||  |||||
  GCAAGGGGACUAAAACUAGAUUGCUGUUCUACCAAGUAAUCCAU  -3'  28nt
                  UAGAUUGCUGUUCUACCAAGUAA       -3'  23nt
                  UAGAUUGCUGUUCUACCAAG           -3'  20nt
```

3'-..AUCUAACGACAAGAUGGUUCAUUAGGUA.. - 5' ssRNA 1

3'-..AUUUAACGACAAGAUGGUUCAUUAGGUA.. - 5' ssRNA 2

| | | |
|---|---|---|
| UAGAUUGCUGUUCUACC.. | None | |
| AAGAUUGCUGUUCUACC.. | 1 | |
| UUGAUUGCUGUUCUACC.. | 2 | crRNA |
| UAGUUUGCUGUUCUACC.. | 4 | mismatch |
| UAGAAUGCUGUUCUACC.. | 5 | position |
| UAGAUAGCUGUUCUACC.. | 6 | |
| UAGAUUCCUGUUCUACC.. | 7 | |

FIG. 57

B
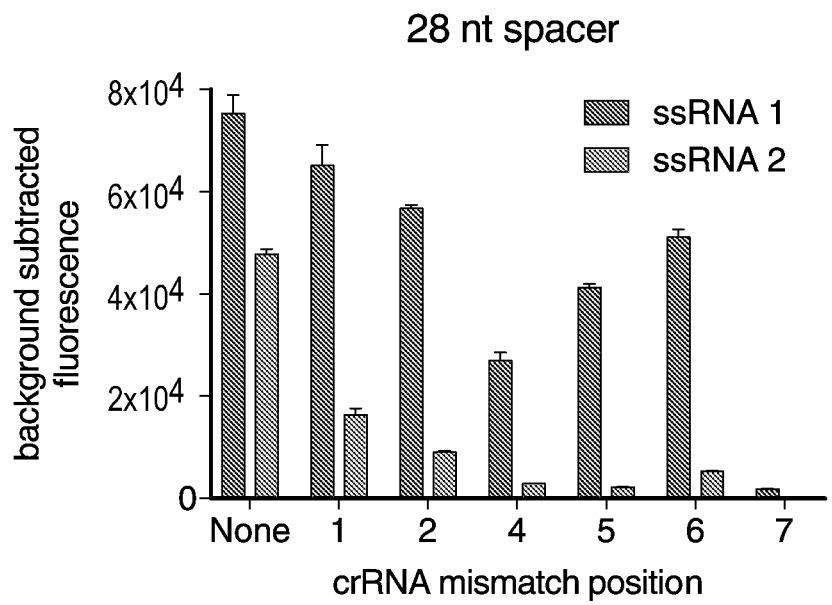
C
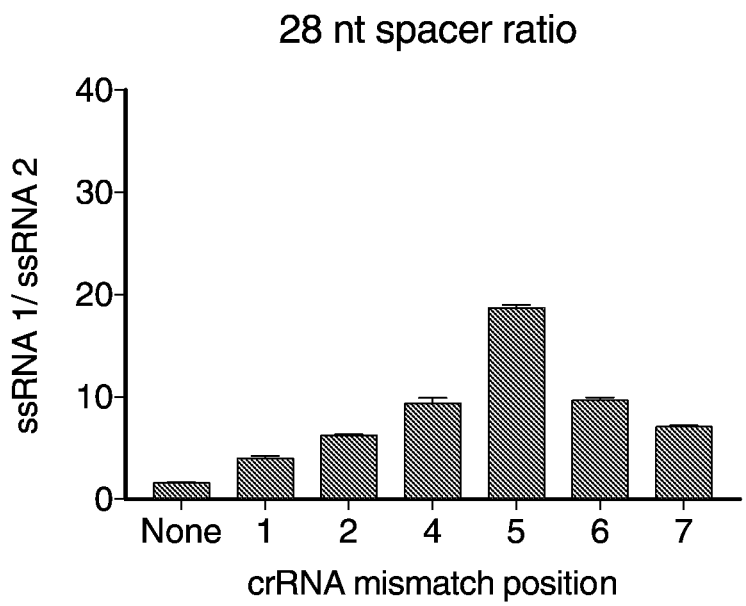
FIG. 57 (continued)

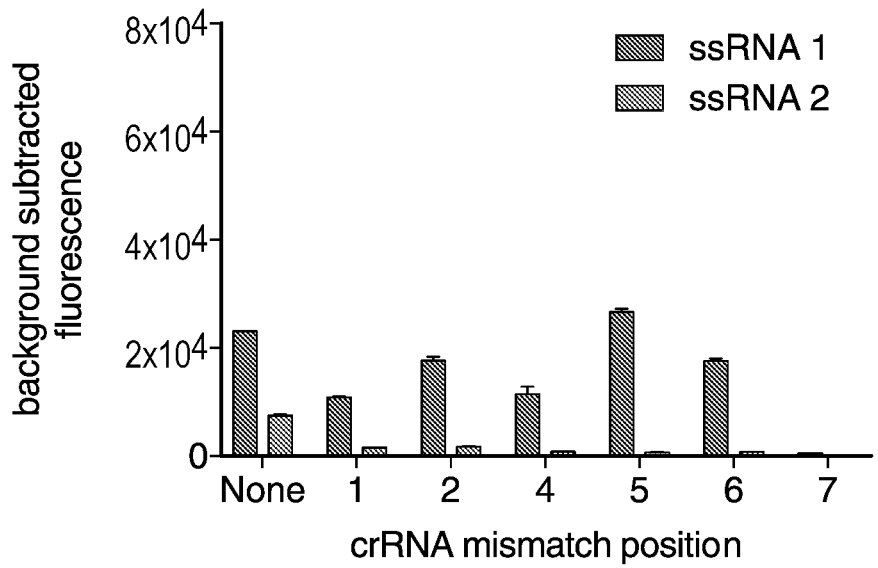
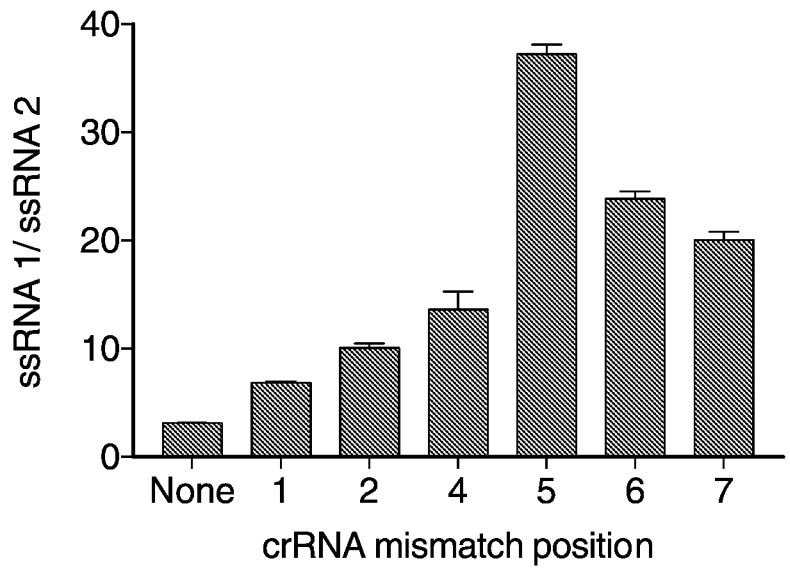
FIG. 57 (continued)

F
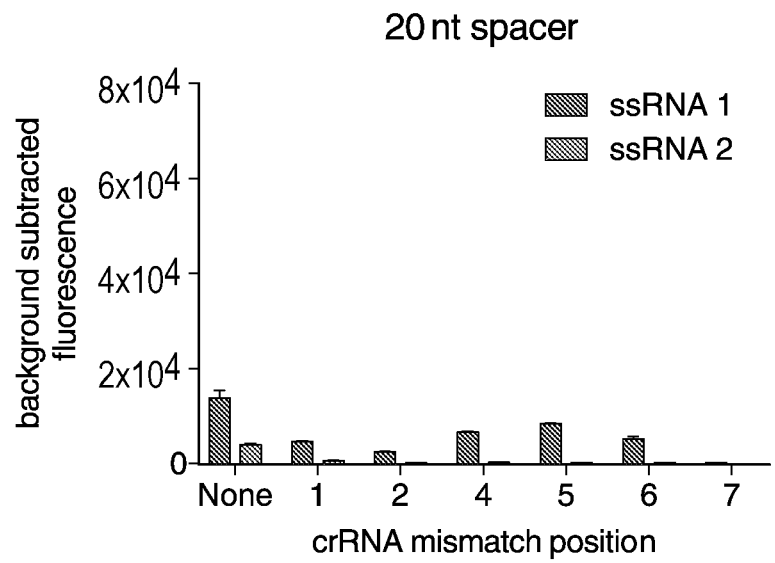
G
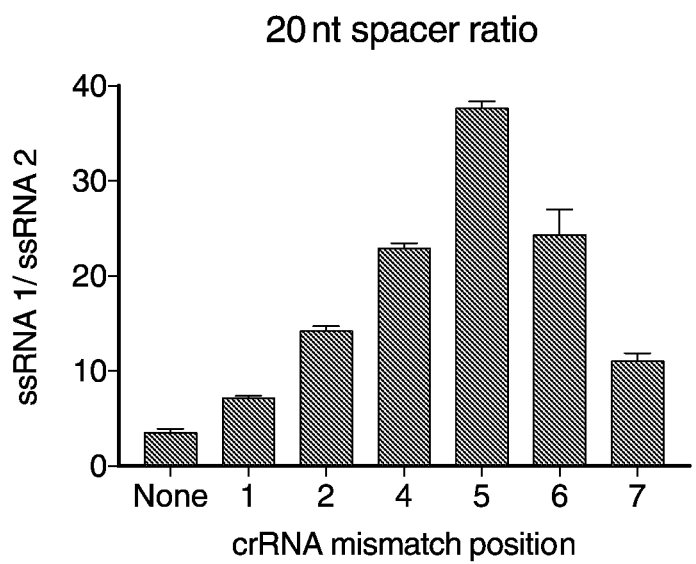
FIG. 57 (continued)

A

```
            3'-..CUCAUCUAACGACAAGAUGGUUCAUUAGGUA.. - 5' ssRNA 1
            3'-..CUCAU■UAACGACAAGAUGGUUCAUUAGGUA.. - 5' ssRNA 2

..AAGAUUGCUGUUCUACCAAGUAAUCCAU  1
                    ..UUGAUUGCUGUUCUACCAAGUAAUCCAU  2
 target            ..UAGUUUGCUGUUCUACCAAGUAAUCCAU  4   crRNA
 mismatch           ..UAGAAUGCUGUUCUACCAAGUAAUCCAU  5   mismatch
 position           ..UAGAUAGCUGUUCUACCAAGUAAUCCAU  6   position
    3               ..UAGAUCCUGUUCUACCAAGUAAUCCAU  7

3'-..CUCAUCUAACGACAAGAUGGUUCAUUAGGUA.. - 5' ssRNA 1
            3'-..CUCAU■UAACGACAAGAUGGUUCAUUAGGUA.. - 5' ssRNA 2

..CUAGAUUGCUGUUCUACCAAGUAAUCCA  1
                    ..GAAGAUUGCUGUUCUACCAAGUAAUCCA  2
 target            ..GUUGAUUGCUGUUCUACCAAGUAAUCCA  3   crRNA
 mismatch           ..GUAGUUUGCUGUUCUACCAAGUAAUCCA  5   mismatch
 position           ..GUAGAAUGCUGUUCUACCAAGUAAUCCA  6   position
    4               ..GUAGAUAGCUGUUCUACCAAGUAAUCCA  7

3'-..CUCAUCUAACGACAAGAUGGUUCAUUAGGUA.. - 5' ssRNA 1
            3'-..CUCAU■UAACGACAAGAUGGUUCAUUAGGUA.. - 5' ssRNA 2

..ACUAGAUUGCUGUUCUACCAAGUAAUCC  2
                    ..AGAAGAUUGCUGUUCUACCAAGUAAUCC  3
 target            ..AGUUGAUUGCUGUUCUACCAAGUAAUCC  4   crRNA
 mismatch           ..AGUAGUUUGCUGUUCUACCAAGUAAUCC  6   mismatch
 position           ..AGUAGAAUGCUGUUCUACCAAGUAAUCC  7   position
    5               ..AGUAGAUAGCUGUUCUACCAAGUAAUCC  8

3'-..CUCAUCUAACGACAAGAUGGUUCAUUAGGUA.. - 5' ssRNA 1
            3'-..CUCAU■UAACGACAAGAUGGUUCAUUAGGUA.. - 5' ssRNA 2

..GACUAGAUUGCUGUUCUACCAAGUAAUC  3
                    ..GAGAAGAUUGCUGUUCUACCAAGUAAUC  4
 target            ..GAGUUGAUUGCUGUUCUACCAAGUAAUC  5   crRNA
 mismatch           ..GAGUAGUUUGCUGUUCUACCAAGUAAUC  7   mismatch
 position           ..GAGUAGAAUGCUGUUCUACCAAGUAAUC  8   position
    6               ..GAGUAGAUAGCUGUUCUACCAAGUAAUC  9
```

FIG. 58

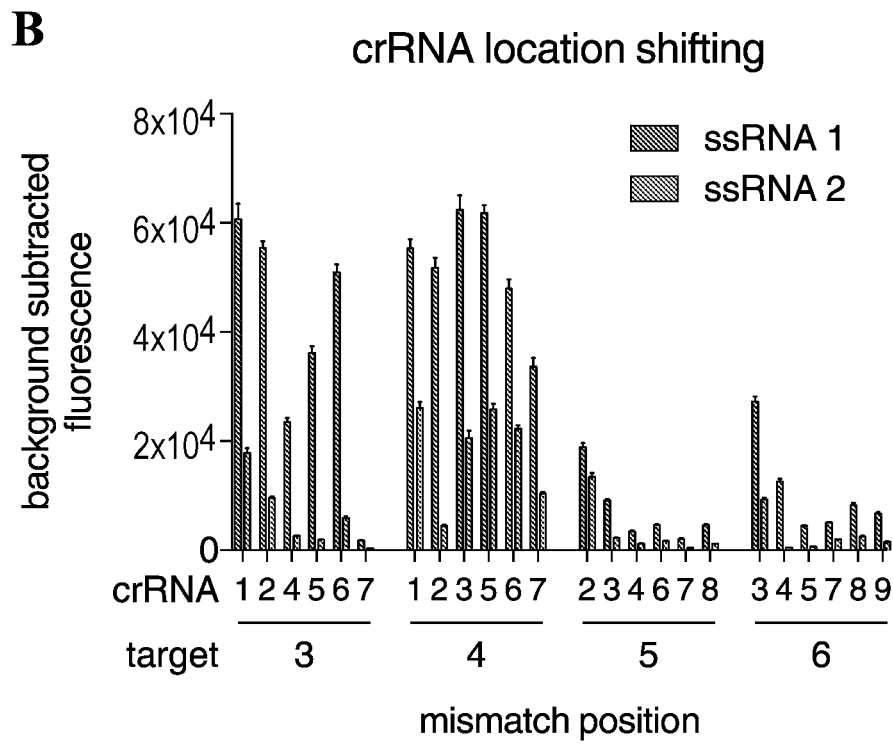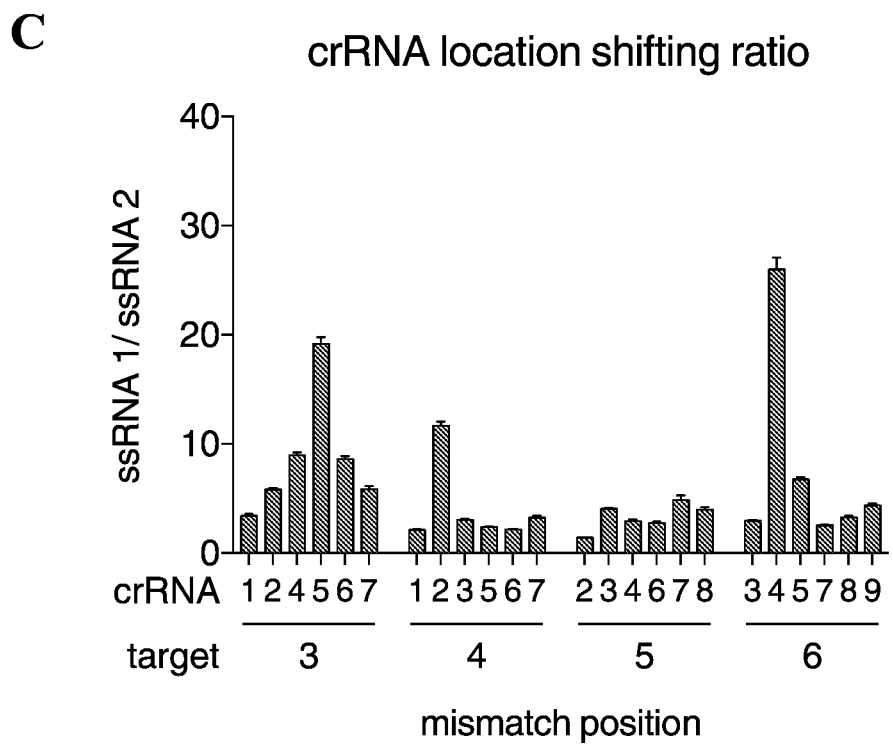
FIG. 58 (continued)

A
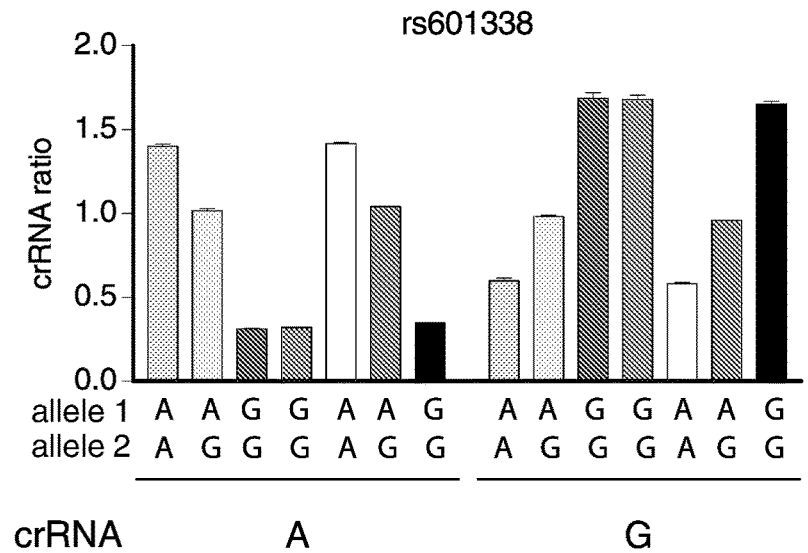
B
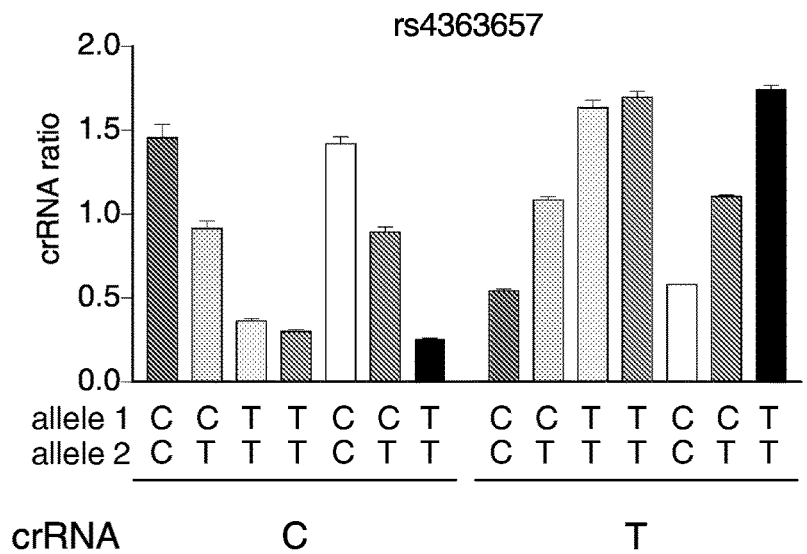
FIG. 60

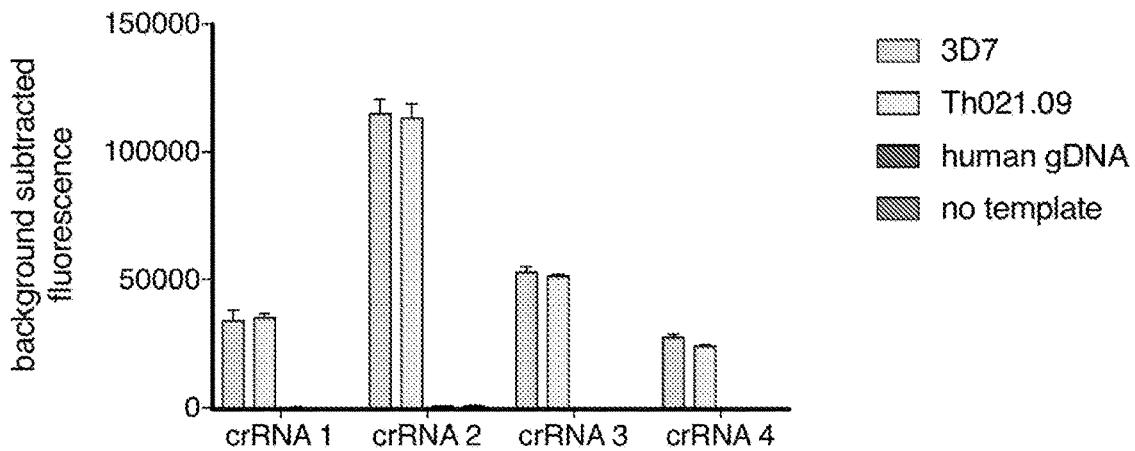

| | |
|---|---|
| gaaattaatacgactcactatagggTTATTGCAATTATTAATCTTGAACGAGGAATG | P. falciparum target 1 primer set 1 F |
| gaaattaatacgactcactatagggGATTGACAGATTAATAGCTCTTTCTTGATTTC | P. falciparum target 1 primer set 2 F |
| ATTTTTCTTGTCCAAACAATTCATCATATCTT | P. falciparum target 1 primer set 1 R |
| TTCAATTTCAAATAAGAATATAGTGTACTCGC | P. falciparum target 1 primer set 2 R |
| gaaattaatacgactcactatagggTTCTTATTAGCAGAACAAAGAAGTTTAACAAC | P. falciparum target 2 primer set 1 F |
| gaaattaatacgactcactatagggATTTTATGCAATGTTAAAAACTGTTCCAAGTA | P. falciparum target 2 primer set 2 F |
| TAATTGACATCCAATCCATAATAAAGCATAGA | P. falciparum target 2 primer set 1 R |
| GAATTATAGTTGTTAAACTTCTTTGTTCTGCT | P. falciparum target 2 primer set 2 R |
| cctagtaagcatgattcatcagattgtggttttagtcccttcgttttgggtagtctaaatcccctatagtgagtcgtattaatttc | P. falciparum target 1 primer set 1 crRNA |
| ggatggtgatgcatggccgttttagttgttttagtcccttcgttttgggtagtctaaatcccctatagtgagtcgtattaatttc | P. falciparum target 1 primer set 2 crRNA |
| caatttaaaatgattttgggtgctagagggttttagtcccttcgttttgggtagtctaaatcccctatagtgagtcgtattaatttc | P. falciparum target 2 primer set 1 crRNA |
| gctggtttagtaattgtattattatcatgttttagtcccttcgttttgggtagtctaaatcccctatagtgagtcgtattaatttc | P. falciparum target 2 primer set 2 crRNA |

FIG. 66

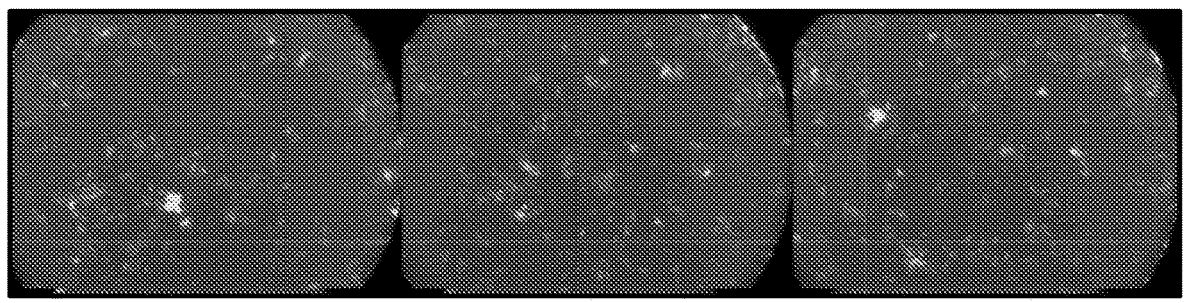
Control, empty vector
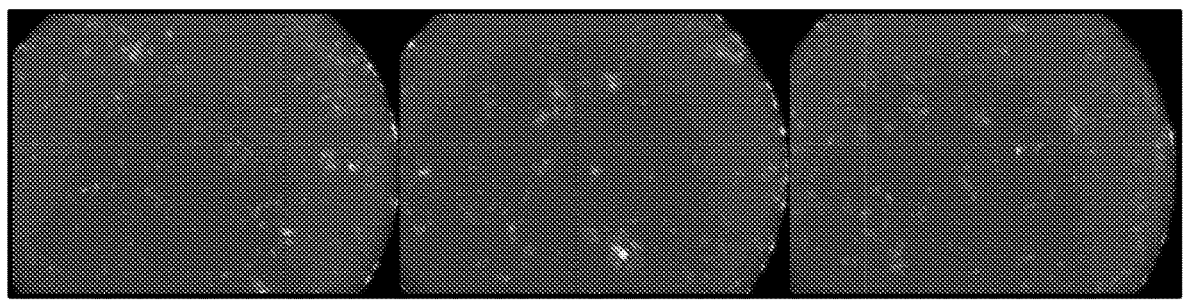
Guide targeting L (#104)
FIG. 73

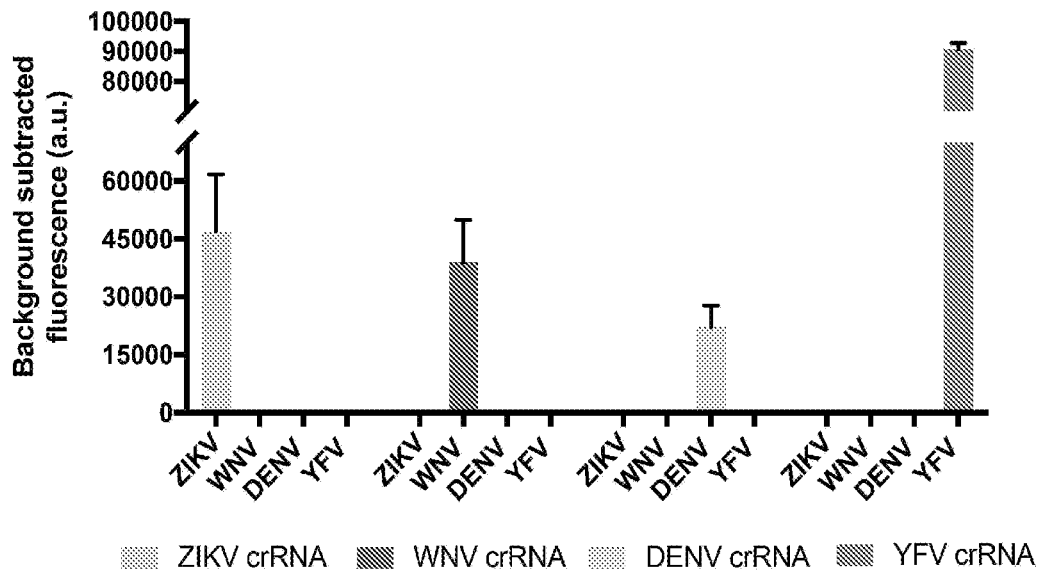
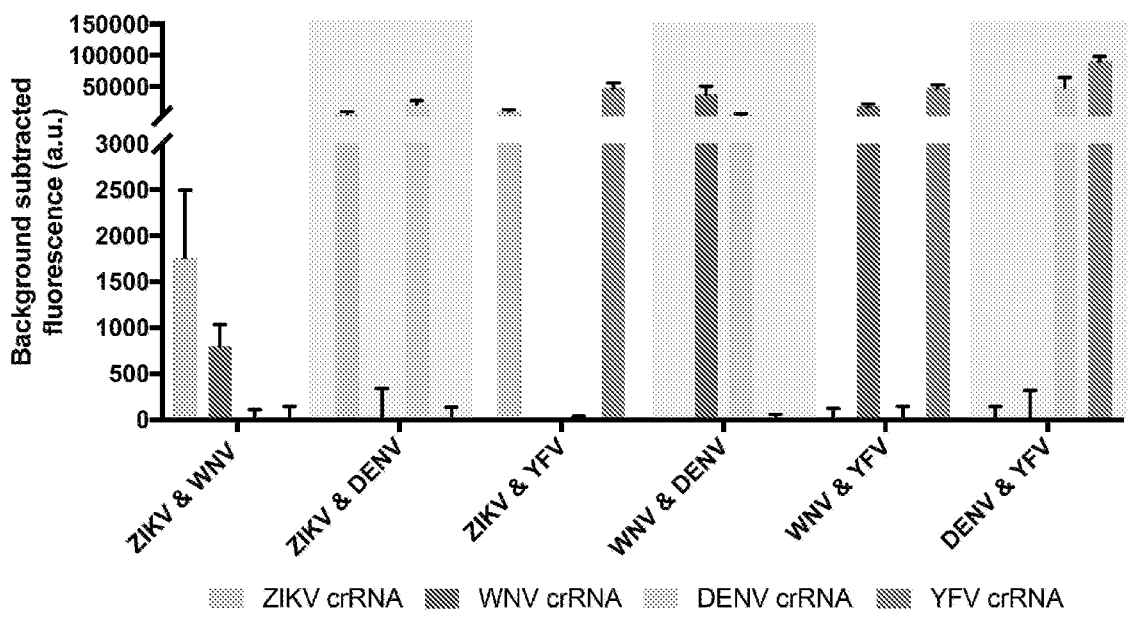
FIG. 80

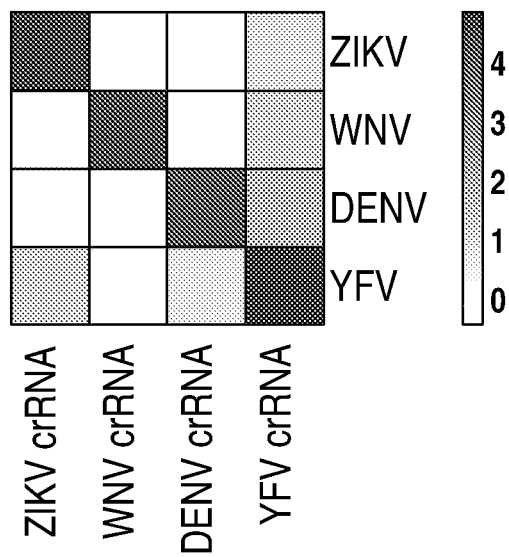
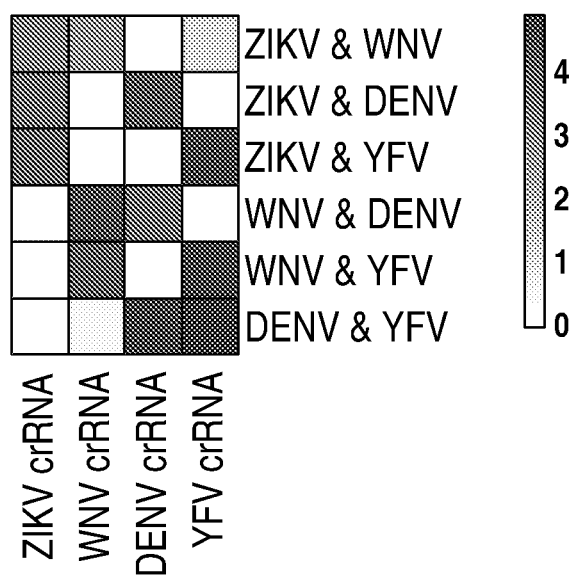
FIG. 81

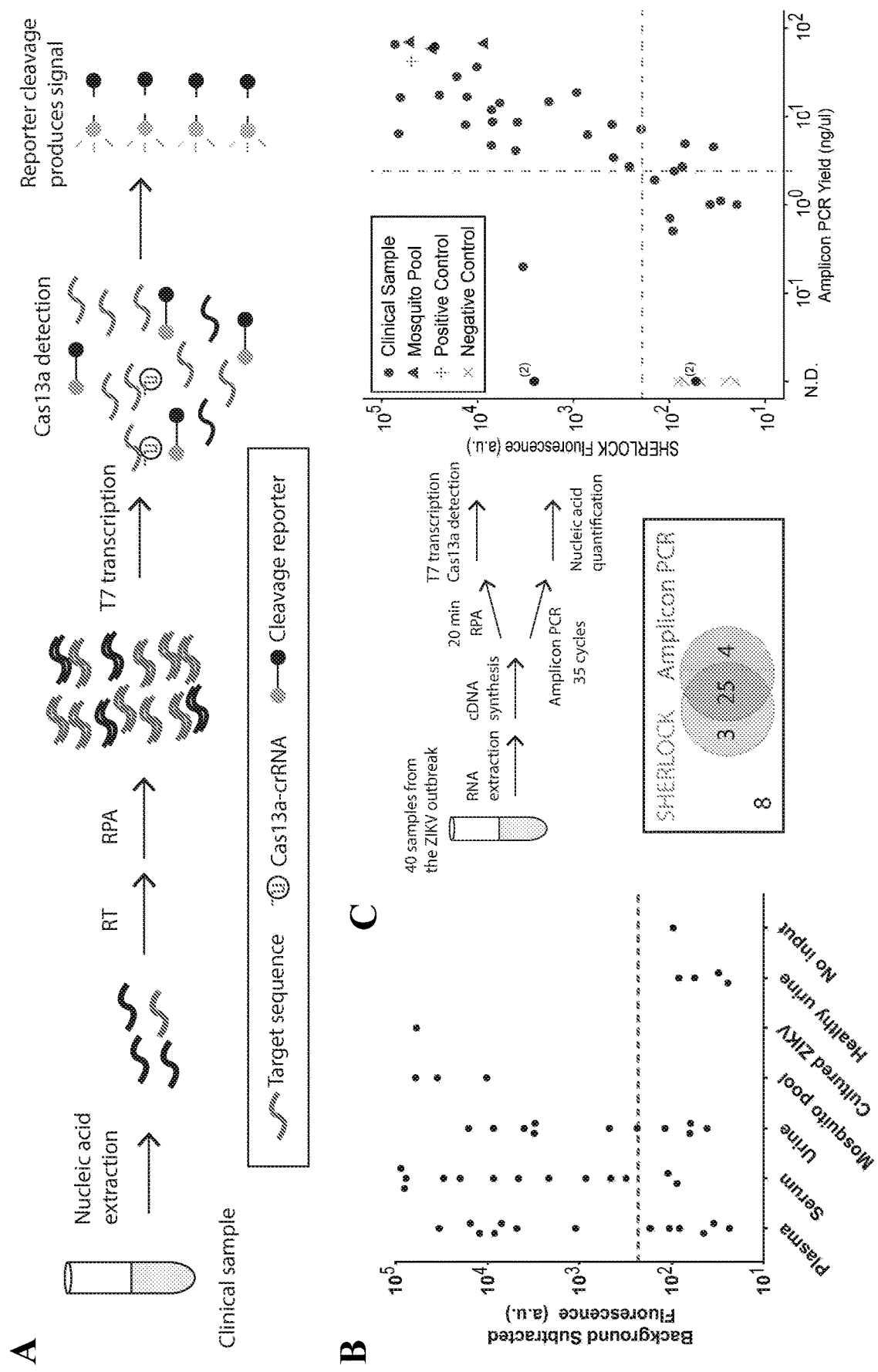
FIG. 82A-C

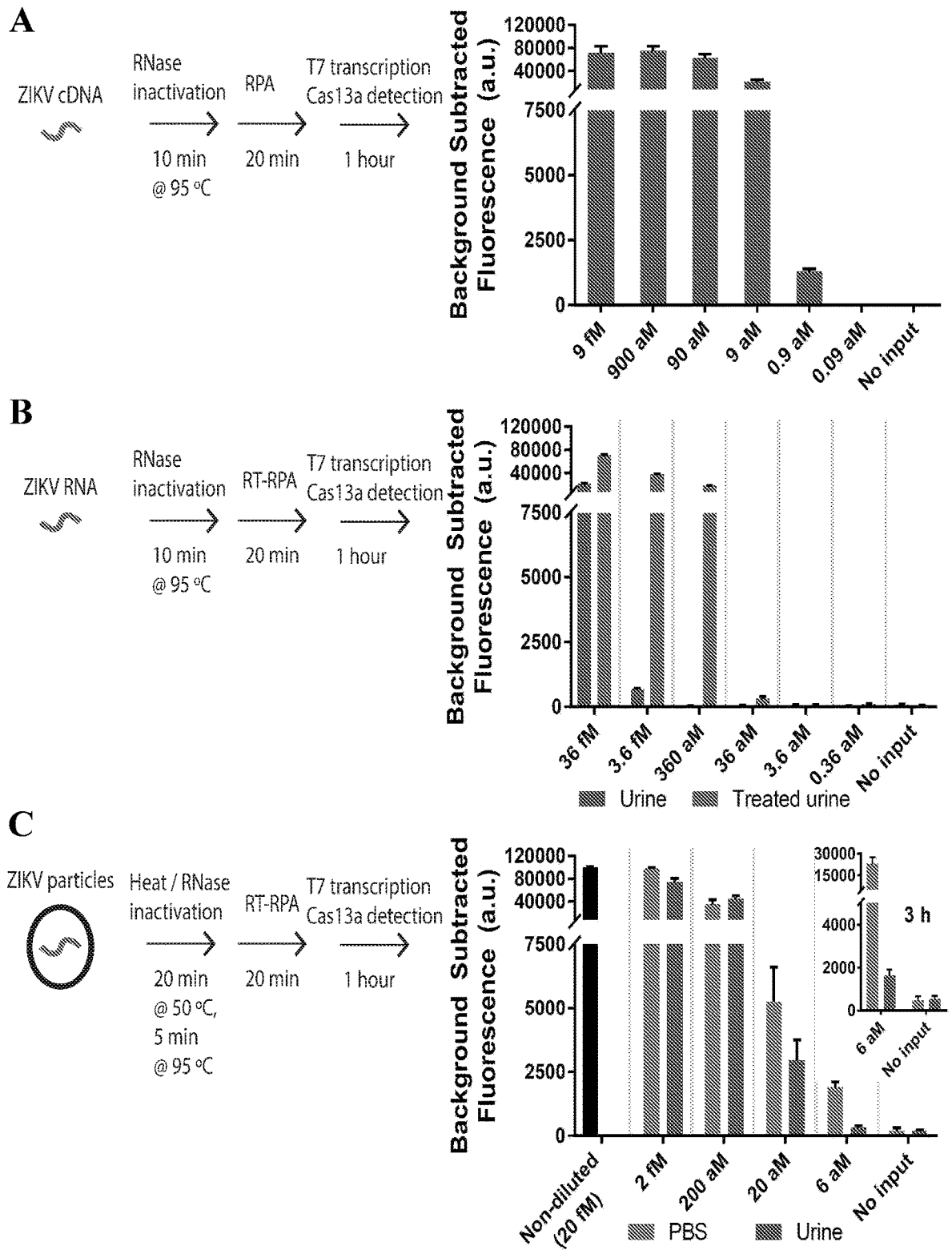
FIG. 83A-C

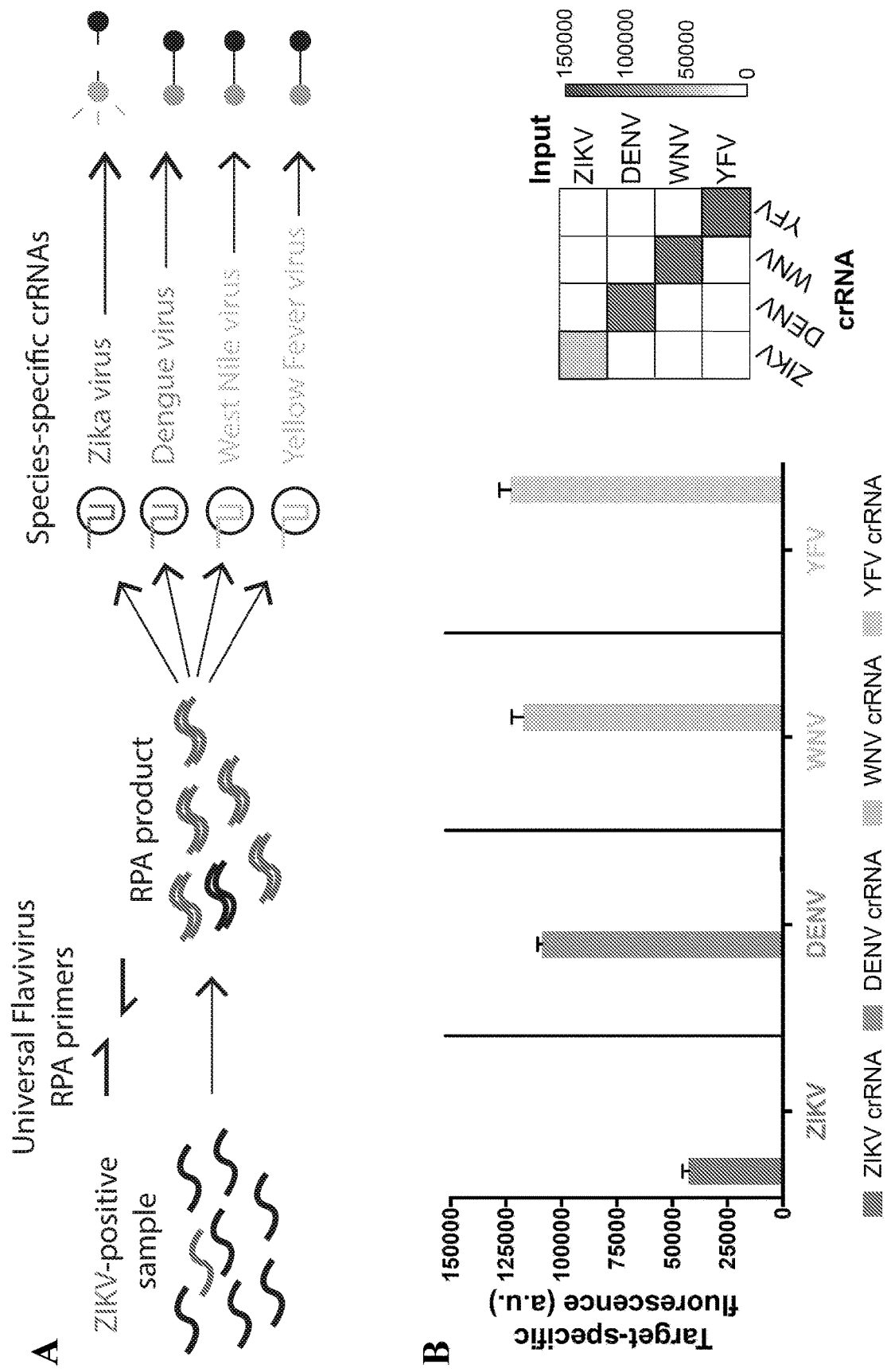
FIG. 84A-B

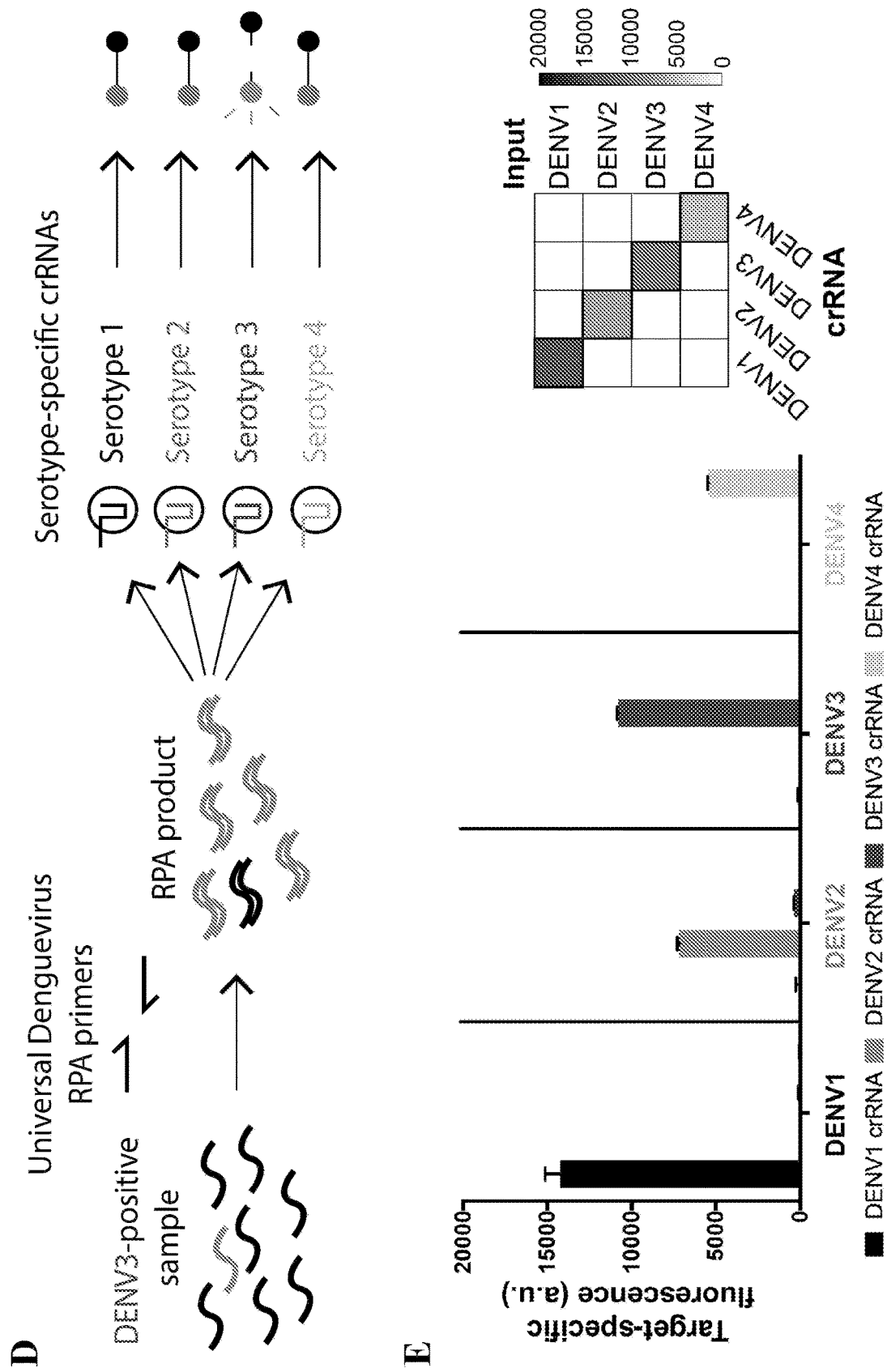
FIG. 84D-E

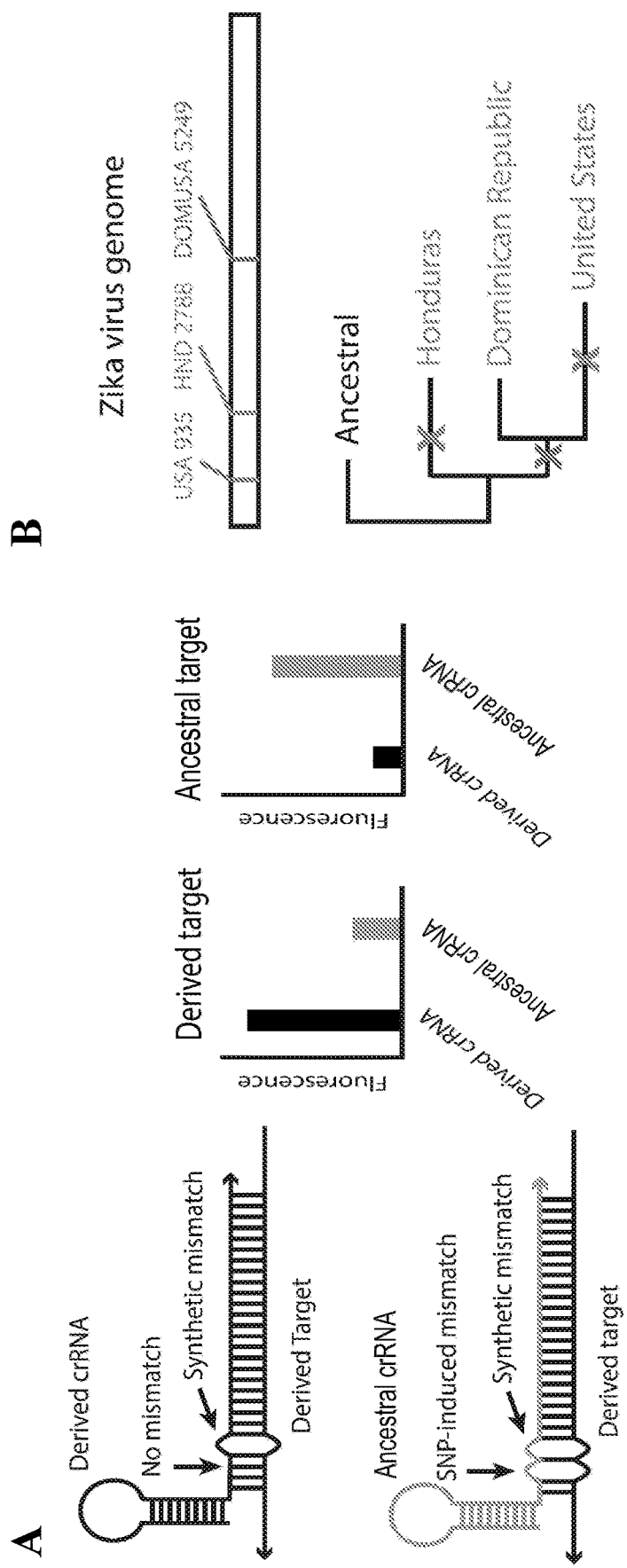
FIG. 85A-B

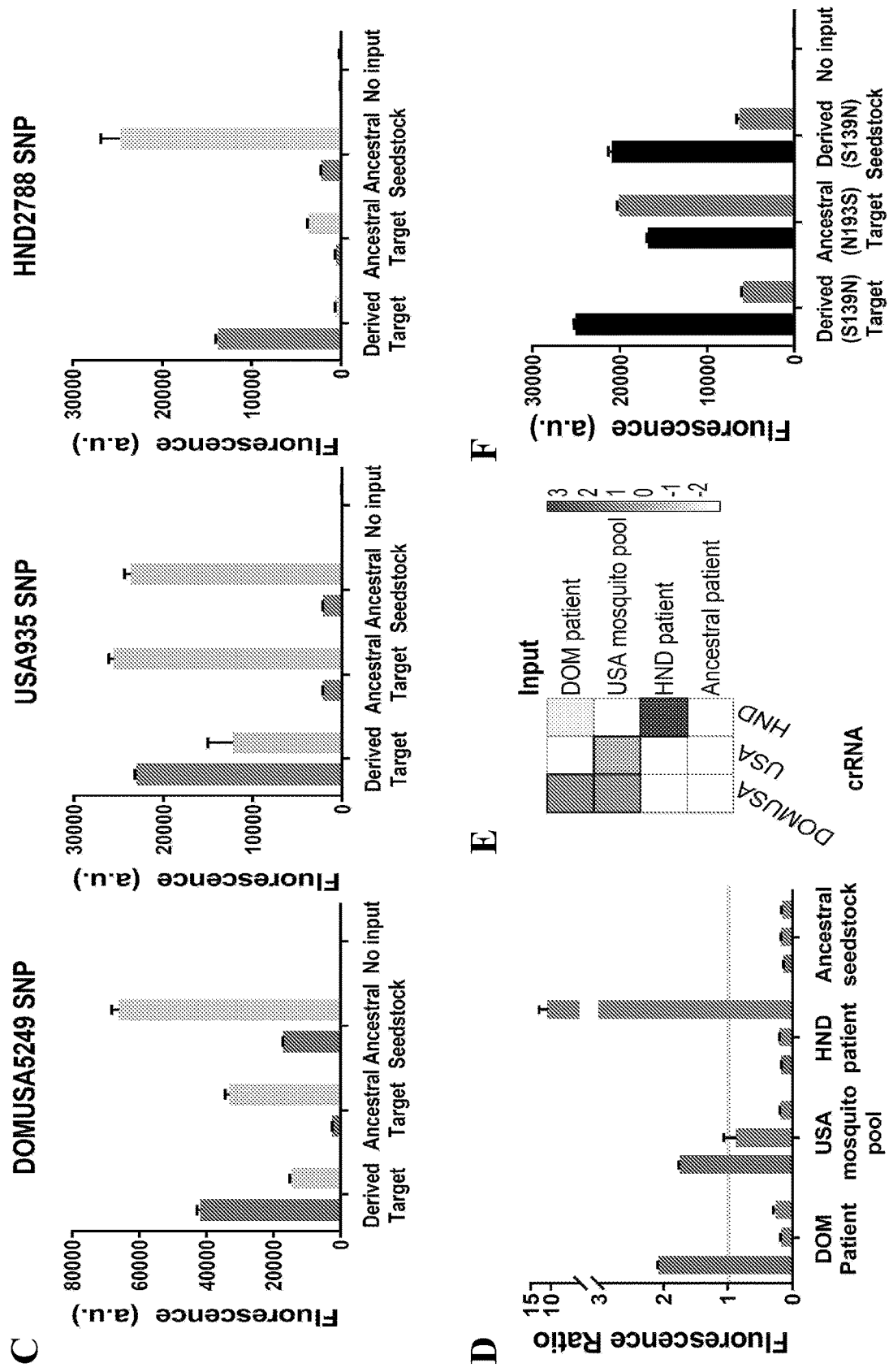
FIG. 85C-F

CRISPR EFFECTOR SYSTEM BASED DIAGNOSTICS FOR VIRUS DETECTION

CROSS REFERENCE TO RELATED APPLICATIONS

This application is a National Stage application of International Application No. PCT/US2018/022764, filed Mar. 15, 2018, which claims the benefit of U.S. Provisional Application No. 62/471,931 filed Mar. 15, 2017, U.S. Provisional Application 62/484,857 filed Apr. 12, 2017, U.S. Provisional Application 62/530,086 filed Jul. 7, 2017, U.S. Provisional Application 62/568,315 filed Oct. 5, 2017, U.S. Provisional Application U.S. 62/588,138 filed Nov. 17, 2017, and U.S. Provisional Application 62/596,735 filed Dec. 8, 2017. The entire contents of the above-identified applications are hereby fully incorporated herein by reference.

STATEMENT REGARDING FEDERALLY SPONSORED RESEARCH

This invention was made with government support under grant numbers MH100706, MH110049, AI1 10818 awarded by the National Institutes of Health, and grant numbers HDTRA1-14-1-0006 and D18AC00006 awarded by the Defense Threat Reduction Agency. The government has certain rights in the invention.

PARTIES TO A JOINT RESEARCH AGREEMENT

The claimed invention was made by, or on behalf of, and/or in connection with one or more of the following parties to a joint research agreement: the Broad Institute, Inc., Massachusetts Institute of Technology, and President and Fellows of Harvard College. The joint research agreement was in effect on and before the date the claimed invention was made, and the claimed invention was made as a result of activities undertaken within the scope of the joint research agreement.

REFERENCE TO AN ELECTRONIC SEQUENCE LISTING

The contents of the electronic sequence listing (BROD-2039US_ST25.txt"; size is 2,803,464 bytes, and it was created on Sep. 13, 2022) is herein incorporated by reference in its entirety.

TECHNICAL FIELD

The subject matter disclosed herein is generally directed to rapid diagnostics related to the use of CRISPR effector systems.

BACKGROUND

Nucleic acids are a universal signature of biological information. The ability to rapidly detect nucleic acids with high sensitivity and single-base specificity on a portable platform has the potential to revolutionize diagnosis and monitoring for many diseases, provide valuable epidemiological information, and serve as a generalizable scientific tool. Although many methods have been developed for detecting nucleic acids (Du et al., 2017; Green et al., 2014; Kumar et al., 2014; Pardee et al., 2014; Pardee et al., 2016; Urdea et al., 2006), they inevitably suffer from trade-offs among sensitivity, specificity, simplicity, and speed. For example, qPCR approaches are sensitive but are expensive and rely on complex instrumentation, limiting usability to highly trained operators in laboratory settings. Other approaches, such as new methods combining isothermal nucleic acid amplification with portable platforms (Du et al., 2017; Pardee et al., 2016), offer high detection specificity in a point-of-care (POC) setting, but have somewhat limited applications due to low sensitivity. As nucleic acid diagnostics become increasingly relevant for a variety of healthcare applications, detection technologies that provide high specificity and sensitivity at low-cost would be of great utility in both clinical and basic research settings.

SUMMARY

In one aspect, the invention provides a nucleic acid detection system comprising: a CRISPR system comprising an effector protein and one or more guide RNAs designed to bind to corresponding target molecules; an RNA-based masking construct; and optionally, nucleic acid amplification reagents to amplify target RNA molecules in a sample. In another aspect, the embodiments provide a polypeptide detection system comprising: a CRISPR system comprising an effector protein and one or more guide RNAs designed to bind a trigger RNA, an RNA-based masking construct; and one or more detection aptamers comprising a masked RNA polymerase promoter binding site or a masked primer binding site.

In further embodiments, the system may further comprise nucleic acid amplification reagents. The nucleic acid amplification reagents may comprise a primer comprising an RNA polymerase promoter. In certain embodiments, sample nucleic acids are amplified to obtain a DNA template comprising an RNA polymerase promoter, whereby a target RNA molecule may be generated by transcription. The nucleic acid may be DNA and amplified by any method described herein. The nucleic acid may be RNA and amplified by a reverse transcription method as described herein. The aptamer sequence may be amplified upon unmasking of the primer binding site, whereby a trigger RNA is transcribed from the amplified DNA product. The target molecule may be a target DNA and the system may further comprise a primer that binds the target DNA and comprises an RNA polymerase promoter.

In one example embodiment, the CRISPR system effector protein is an RNA-targeting effector protein. Example RNA-targeting effector proteins include C2c2 (now known as Cas13a), Cas13b, and Cas13a. It will be understood that the term "C2c2" herein is used interchangeably with "Cas13a." In another example embodiment, the RNA-targeting effector protein is C2c2. In other embodiments, the C2c2 effector protein is from an organism of a genus selected from the group consisting of: *Leptotrichia, Listeria*, Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*, or the C2c2 effector protein is an organism selected from the group consisting of: *Leptotrichia shahii, Leptotrichia. wadei, Listeria seeligeri, Clostridium aminophilum, Carnobacterium gallinarum, Paludibacter propionicigenes, Listeria weihenstephanensis*, or the C2c2 effector protein is a *L. wadei* F0279 or *L. wadei* F0279 (Lw2) C2C2 effector protein. In another embodiment, the one or more guide RNAs are designed to detect a single nucleotide polymorphism, splice variant of a transcript, or a frameshift mutation in a target RNA or DNA.

In other embodiments, the one or more guide RNAs are designed to bind to one or more target molecules that are diagnostic for a disease state. In still further embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease. In still further embodiments, the disease state is cancer or an autoimmune disease or an infection.

In further embodiments, the one or more guide RNAs are designed to bind to one or more target molecules comprising cancer specific somatic mutations. The cancer specific mutation may confer drug resistance. The drug resistance mutation may be induced by treatment with ibrutinib, erlotinib, imatinib, gefitinib, crizotinib, trastuzumab, vemurafenib, RAF/MEK, check point blockade therapy, or antiestrogen therapy. The cancer specific mutations may be present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT1, BRAF, MEK1, MEK2, NRAS, RAC1, and ESR1. The cancer specific mutation may be a mutation in a gene selected from the group consisting of CASP8, B2M, PIK3CA, SMC1A, ARID5B, TET2, ALPK2, COL5A1, TP53, DNER, NCOR1, MORC4, CIC, IRF6, MYOCD, ANKLE1, CNKSR1, NF1, SOS1, ARID2, CUL4B, DDX3X, FUBP1, TCP11L2, HLA-A, B or C, CSNK2A1, MET, ASXL1, PD-L1, PD-L2, IDO1, IDO2, ALOX12B and ALOX15B, or copy number gain, excluding whole-chromosome events, impacting any of the following chromosomal bands: 6916.1-q21, 6q22.31-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p13.2, 17p13.1 (containing ALOX12B, ALOX15B), and 22q11.1-q11.21.

In further embodiments, the one or more guide RNAs may be designed to bind to one or more target molecules comprising loss-of-heterozygosity (LOH) markers.

In further embodiments, the one or more guide RNAs may be designed to bind to one or more target molecules comprising single nucleotide polymorphisms (SNP). The disease may be heart disease and the target molecules may be VKORC1, CYP2C9, and CYP2C19.

In further embodiments, the disease state may be a pregnancy or childbirth-related disease or an inherited disease. The sample may be a blood sample or mucous sample. The disease may be selected from the group consisting of Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, *Porphyria*, Fragile-X-Syndrome, Robertsonian translocation, Angelman syndrome, DiGeorge syndrome and Wolf-Hirschhorn Syndrome.

In further embodiments, the infection is caused by a virus, a bacterium, or a fungus, or the infection is a viral infection. In specific embodiments, the viral infection is caused by a double-stranded RNA virus, a positive sense RNA virus, a negative sense RNA virus, a retrovirus, or a combination thereof, or the viral infection is caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus, or the viral infection is caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In other embodiments of the invention, the RNA-based masking construct suppresses generation of a detectable positive signal or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In further embodiments, the RNA-based masking construct is a ribozyme that generates the negative detectable signal, and wherein the positive detectable signal is generated when the ribozyme is deactivated, or the ribozyme converts a substrate to a first color and wherein the substrate converts to a second color when the ribozyme is deactivated.

In other embodiments, the RNA-based masking agent is an RNA aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal.

In another embodiment, the RNA-based masking construct comprises an RNA oligonucleotide to which a detectable ligand and a masking component are attached. In another embodiment, the detectable ligand is a fluorophore, and the masking component is a quencher molecule, or the reagents to amplify target RNA molecules such as, but not limited to, NASBA or RPA reagents.

In another aspect, the invention provides a diagnostic device comprising one or more individual discrete volumes, each individual discrete volumes comprising a CRISPR effector protein, one or more guide RNAs designed to bind to corresponding target molecule, an RNA-based masking construct, and optionally further comprise nucleic acid amplification reagents.

In another aspect, the invention provides a diagnostic device comprising one or more individual discrete volumes, each individual discrete volume comprising a CRISPR effector protein, one or more guide RNAs designed to bind to a trigger RNA, one or more detection aptamers comprising a masked RNA polymerase promoter binding site or a masked primer binding site, and optionally further comprising nucleic acid amplification reagents.

In some embodiments, the individual discrete volumes are droplets, or the individual discrete volumes are defined on a solid substrate, or the individual discrete volumes are microwells, or the individual discrete volumes are spots defined on a substrate, such as a paper substrate.

In certain other example embodiments, the nucleic acid detection system is designed to detect one or more viral targets and used in conjunction an anti-viral therapeutic. In certain example embodiments, the anti-viral therapeutic is a Class 2, type VI CRISPR-based anti-viral system. For example, the nucleic acid detection systems may be used with the anti-viral systems to drug resistance or susceptibility of viral strains infecting a particular patient or prevalent in a given outbreak to select an appropriate therapeutic agent. This includes diagnostic systems that can detect novel mutations that arise in the course of therapy as well as mutations known to arise which lead to treatment resistance. Such diagnostic system embodiments disclosed herein may be used as companion diagnostics to anti-viral therapeutics to select an appropriate initial anti-viral therapy and also to modify an anti-viral therapy in response to resistant mutants that may emerge. In example embodiments in which the anti-viral is a Class 2, type VI CRISPR-based anti-viral therapeutic, the diagnostic system embodiments disclosed herein may be used to select and/or modify the guide sequence used by the Class 2, type VI CRISPR-based anti-viral therapeutic to direct the effector protein against the target viral agent nucleic acid sequences.

In one embodiment, the RNA targeting effector protein is a CRISPR Type VI RNA-targeting effector protein such as C2c2, Cas13b, or Cas13c. In certain example embodiments, the C2c2 effector protein is from an organism selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*, or the C2c2 effector protein is selected from the group consisting of: *Leptotrichia shahii, L. wadei, Listeria seeligeri*, Lachnospiraceae *bacterium, Clostridium aminophilum, Carnobacterium gallinarum, Paludibacter propionicigenes, Listeria weihenstephanensis*, Listeriaceae *bacterium*, and *Rhodobacter capsulatus*, the C2c2 effector protein is a *L. wadei* F0279 or *L. wadei* F0279 (Lw2) C2c2 effector protein. In another embodiment, the one or more guide RNAs are designed to bind to one or more target RNA sequences that are diagnostic for a disease state.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In another example embodiment, the RNA-based masking construct is a ribozyme that generates a negative detectable signal, and wherein the positive detectable signal is generated when the ribozyme is deactivated. In one example embodiment, the ribozyme converts a substrate to a first color and wherein the substrate converts to a second color when the ribozyme is deactivated. In another example embodiment, the RNA-based masking agent is an aptamer that sequesters an enzyme, wherein the enzyme generates a detectable signal upon release from the aptamer by acting upon a substrate, or the aptamer sequesters a pair of agents that when released from the aptamers combine to generate a detectable signal.

In another example embodiment, the RNA-based masking construct comprises an RNA oligonucleotide to which are attached a detectable ligand oligonucleotide and a masking component. In certain example embodiments, the detectable ligand is a fluorophore, and the masking component is a quencher molecule.

In another aspect, the invention provides a method for detecting target RNAs in samples, comprising: distributing a sample or set of samples into one or more individual discrete volumes, the individual discrete volumes comprising a CRISPR system comprising an effector protein, one or more guide RNAs, an RNA-based masking construct; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is produced; and detecting the detectable positive signal, wherein detection of the detectable positive signal indicates a presence of one or more target molecules in the sample.

In another aspect, the invention provides a method for detecting peptides in samples, comprising: distributing a sample or set of samples into a set of individual discrete volumes, the individual discrete volumes comprising peptide detection aptamers, a CRISPR system comprising an effector protein, one or more guide RNAs, an RNA-based masking construct, wherein the peptide detection aptamers comprising a masked RNA polymerase site and configured to bind one or more target molecules; incubating the sample or set of samples under conditions sufficient to allow binding of the peptide detection aptamers to the one or more target molecules, wherein binding of the aptamer to a corresponding target molecule exposes the RNA polymerase binding site resulting in RNA synthesis of a trigger RNA; activating the CRISPR effector protein via binding of the one or more guide RNAs to the trigger RNA, wherein activating the CRISPR effector protein results in modification of the RNA-based masking construct such that a detectable positive signal is produced; and detecting the detectable positive signal, wherein detection of the detectable positive signal indicates a presence of one or more target molecules in a sample.

In certain example embodiments, such methods further comprise amplifying the sample RNA or the trigger RNA. In other embodiments, amplifying RNA comprises amplification by NASBA or RPA.

In certain example embodiments, the CRISPR effector protein is a CRISPR Type VI RNA-targeting effector protein, such as C2c2 or Cas13b. In other example embodiments, the C2c2 effector protein is from an organism selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*, or the C2c2 effector protein is selected from the group consisting of: *Leptotrichia shahii, L. wadei, Listeria seeligeri*, Lachnospiraceae *bacterium, Clostridium aminophilum, Carnobacterium gallinarum, Paludibacter propionicigenes, Listeria weihenstephanensis*, Listeriaceae *bacterium*, and *Rhodobacter capsulatus* In a specific embodiment, the C2c2 effector protein is a *L. wadei* F0279 or *L. wadei* F0279 (Lw2) C2C2 effector protein.

In certain example embodiments, the one or more guide RNAs are designed to bind to one or more target molecules that are diagnostic for a disease state. In certain other example embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease, cancer, or a fungal infection, a bacterial infection, a parasite infection, or a viral infection.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed, or the RNA-based masking construct is a ribozyme that generates the negative detectable signal, and wherein the positive detectable signal is generated when the ribozyme is inactivated. In other example embodiments, the ribozyme converts a substrate to a first state and wherein the substrate converts to a second state when the ribozyme is inactivated, or the RNA-based masking agent is an aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal. In still further embodiments, the RNA-based masking construct comprises an RNA oligonucleotide with a detectable ligand on a first end of the RNA oligonucleotide and a masking component on a second end of the RNA oligonucleotide, or the detectable ligand is a fluorophore, and the masking component is a quencher molecule.

In certain example embodiments, the methods, systems and devices disclosed herein may be used to detect SNPs associated with fetal microencephaly. Example fetal microencephaly mutations that may be detected using the embodiments disclosed herein are disclosed in Yuan et al. Science 10.1126/science.aam7120 (2017).

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

Figure 3:
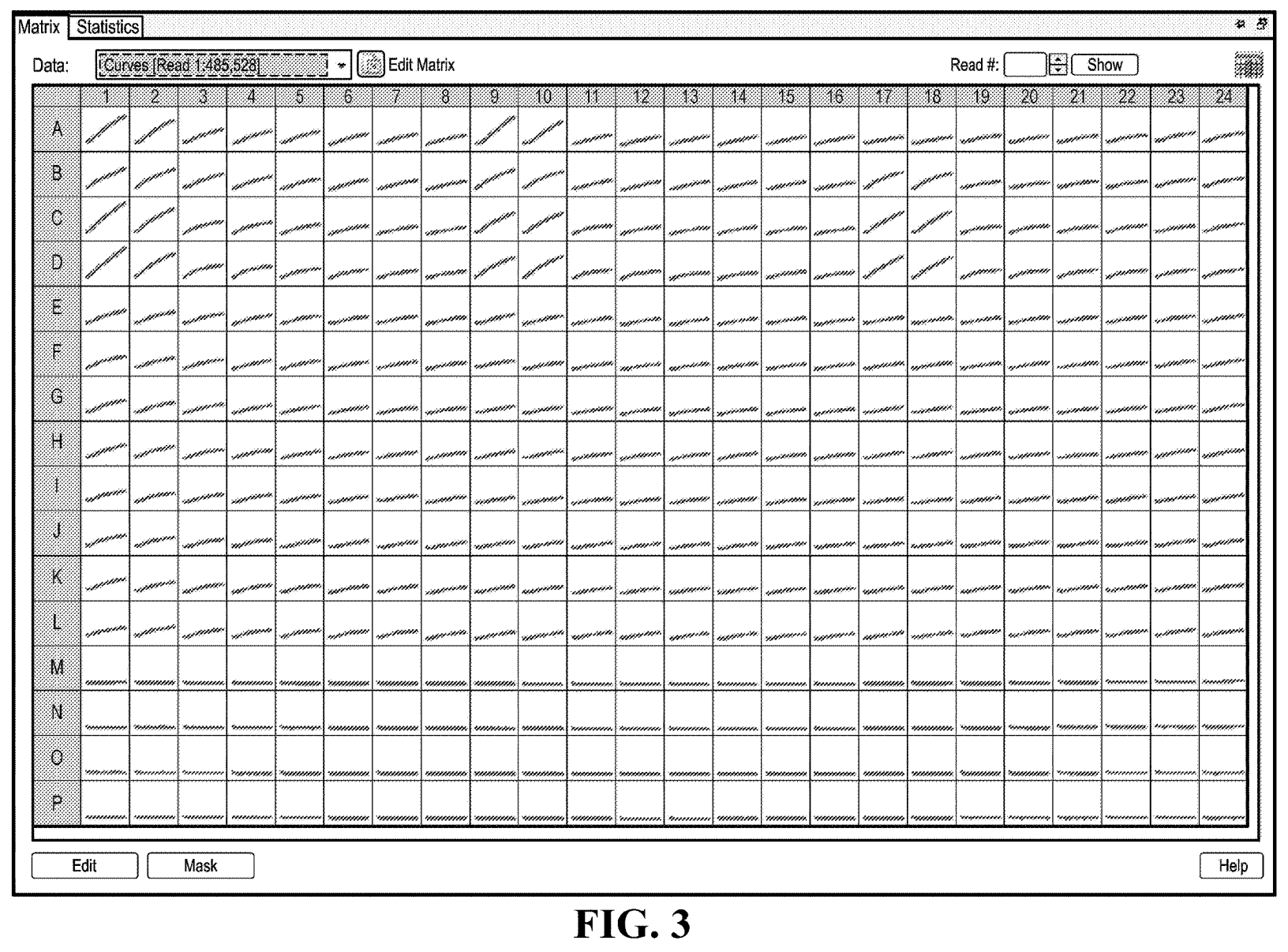

FIGS. 3-6—shows detection of an example masking constructs at different dilutions using 1 μg, 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.

FIG. 31—provides a set of graphs providing (A) a schematic of Zia RNA detection in accordance with certain example embodiments. Lentivirus was packaged with Zika RNA or homologous Dengue RNA fragments targeted by C2c2 collateral detection. Media is harvested after 48 hours and subjected to thermal lysis, RT-RPA, and C2c2 detection. (B) RT-RAP-C2c2 detection is capable of highly sensitive detection of the Zika lentiviral particles (n=4 technical replicates, two-tailed Student t-test;***, p<0.0001; bars represent mean±s.e.m.) (C) A schematic of Zika RNA detection using freeze-dried C2c2 on paper, in accordance with certain example embodiments. (D) The paper-based assay is capable of highly sensitive detection of Zika lentiviral particles (n-4 technical replicates, two-tailed Student t-test; , p<0.0001; , p<0.01, bars represent mean±s.e.m.).

FIG. 32—provides a set of graphs demonstrating (A) A schematic for C2c2 detection of Zika RNA isolated from human serum. Zika RNA in serum is subjected to reverse transcription, RNase H degradation of the RNA, RPA of the cDNA, and C2c2 detection. (B) C2c2 is capable of highly sensitive detection of human Zika serum samples. Concentrations of Zika RNA shown were verified by qPCR (n=4 technical replicates, two-tailed Student t-test;****, p<0.0001; bars represent mean±s.e.m.).

FIG. 37—provides a set of graphs demonstrating: (A) Schematic of Zika strain target regions and the crRNA sequences used for detection. (SEQ ID NOS: 165 through 170) SNPs in the target are highlighted red or blue and synthetic mismatches in the guide sequence are colored red. (B) Highly specific detection of strain SNPs allows for the differentiation of Zika African versus American RNA targets using SHERLOCK. (n=2 technical replicates, two-tailed Student t-test;**, p<0.0001; bars represent mean±s.e.m.) (SEQ ID NOS: 171 through 176) (C) Schematic of Dengue strain target regions and the crRNA sequences used for detection. SNPs in the target are highlighted red or blue and synthetic mismatches in the guide sequence are colored red. (D) Highly specific detection of strain SNPs allows for the differentiation of Dengue strain 1 versus strain 3 RNA targets using SHERLOCK (n=2 technical replicates, two-tailed Student t-test;**, p<0.0001; bars represent mean±s.e.m.) (FIG. 37).

FIG. 39—provides a set of graphs demonstrating that C2c2 can detect the mutant minor allele in mock cell-free DNA samples from the EGFR L858R (C) or the BRAF V600E (B) minor allele (n=4 technical replicates, two tailed Student t-test;*, p<0.05; , p<0.01, **, P<0.0001; bars represent ±s.e.m.).

FIG. 47 is a picture demonstrating that the colorimetric shift is visible on a paper substrate. The test was performed for 10 minutes at 37 degrees C. on glass fiber 934-AH.

FIG. 50 shows the amino acid sequence of the HEPN domains of selected C2c2 orthologues. (SEQ ID NOS: 204-233).

FIG. 52—Cas13a detection can be used to sense viral and bacterial pathogens. (A) Schematic of SHERLOCK detection of ZIKV RNA isolated from human clinical samples. (B) SHERLOCK is capable of highly sensitive detection of human ZIKV-positive serum (S) or urine (U) samples. Approximate concentrations of ZIKV RNA shown were determined by qPCR (n=4 technical replicates, two-tailed Student t-test; ****, p<0.0001; bars represent mean±s.e.m.; n.d., not detected).

FIG. 55—Comparison of SHERLOCK to other sensitive nucleic acid detection tools. (A) Detection analysis of ssDNA 1 dilution series with digital-droplet PCR. (n=4 technical replicates, two-tailed Student t-test; n.s., not significant; *, p<0.05; , p<0.01; , p<0.0001; red lines represent mean, bars represent mean±s.e.m. Samples with measured copy/L below 10–1 not shown.) (B) Detection analysis of ssDNA 1 dilution series with quantitative PCR. (n=16 technical replicates, two-tailed Student t-test; n.s., not significant; , p<0.01; ****, p<0.0001; red lines represent mean, bars represent mean±s.e.m. Samples with relative signal below 10-10 not shown.) (C) Detection analysis of ssDNA 1 dilution series with RPA with SYBR Green II. (n=4 technical replicates, two-tailed Student t-test; *, p<0.05; , p<0.01; red lines represent mean, bars represent mean±s.e.m. Samples with relative signal below 100 not shown.) (D) Detection analysis of ssDNA 1 dilution series with SHERLOCK. (n=4 technical replicates, two-tailed Student t-test; , p<0.01; ****, p<0.0001; red lines represent mean, bars represent mean±s.e.m. Samples with relative signal below 100 not shown.) (E) Percent coefficient of variation for a series of ssDNA 1 dilutions for four types of detection methods. (F) Mean percent coefficient of variation for the 6e2, 6e1, 6e0, and 6e-1 ssDNA 1 dilutions for four types of detection methods (bars represent mean s.e.m.).

FIG. 57—Characterization of LwCas13a sensitivity to truncated spacers and single mismatches in the target sequence. (A) Sequences of truncated spacer crRNAs (SEQ ID NOS: 425-436) used in (B)-(G). Also shown are sequences of ssRNA 1 and 2, which has a single base-pair difference highlighted in red. crRNAs containing synthetic mismatches are displayed with mismatch positions colored in red. (B) Collateral cleavage activity on ssRNA 1 and 2 for 28 nt spacer crRNA with synthetic mismatches at positions 1-7. (n=4 technical replicates; bars represent mean±s.e.m.) (C) Specificity ratios of crRNA tested in (B). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.) (D) Collateral cleavage activity on ssRNA 1 and 2 for 23 nt spacer crRNA with synthetic mismatches at positions 1-7. (n=4 technical replicates; bars represent mean±s.e.m.) (E) Specificity ratios of crRNA tested in (D). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.) (F) Collateral cleavage activity on ssRNA 1 and 2 for 20 nt spacer crRNA with synthetic mismatches at positions 1-7. (n=4 technical replicates; bars represent mean±s.e.m.) (G) Specificity ratios of crRNA tested in (F). Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

FIG. 58.—Identification of ideal synthetic mismatch position relative to mutations in the target sequence. (A) Sequences for evaluation of the ideal synthetic mismatch position to detect a mutation between ssRNA 1 and ssRNA 2 (SEQ ID NOS: 437-462). On each of the targets, crRNAs with synthetic mismatches at the colored (red) locations are tested. Each set of synthetic mismatch crRNAs is designed such that the mutation location is shifted in position relative to the sequence of the spacer. Spacers are designed such that the mutation is evaluated at positions 3, 4, 5, and 6 within the spacer. (B) Collateral cleavage activity on ssRNA 1 and 2 for crRNAs with synthetic mismatches at varying positions. There are four sets of crRNAs with the mutation at either position 3, 4, 5, or 6 within the spacer:target duplex region. (n=4 technical replicates; bars represent mean±s.e.m.) (C) Specificity ratios of crRNA tested in (B). Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

FIG. 66—shows detection of two malaria specific targets with four different guide RNA designs, in accordance with example embodiments. (SEQ ID NOS: 463-474).

FIG. 73—Representative images (3 replicates for each guide) illustrating the reduction of GFP (i.e., LCMV replication) for Guide targeting the coding region of L (#104) compared to the control (empty guide vector). Images were taken 48 hours post LCMV infection at magnification of 4×. Fold change 2.72, p value 0.047.

FIG. 81—Panels A and B show alternative representations of the measured fluorescence represented in the bar plots in FIGS. 80B and 80C, respectively. The gradient is the log 10 scaled fluorescence at 3 hours.

FIG. 82—Sensitive ZIKV detection from clinical samples and mosquito pools. (A) A schematic of SHERLOCK applied to clinical samples. Nucleic acid is extracted from clinical samples and the target molecule is amplified by recombinase polymerase amplification (RPA). RNA samples are reversed-transcribed (RT) prior to RPA. RPA products are detected using a reaction containing T7 RNA polymerase (for in vitro transcription of the dsDNA RPA product), purified Cas13a, crRNA, and an RNA reporter that fluoresces when cleaved. (B) Testing SHERLOCK on 40 samples collected during the 2016 ZIKV outbreak. SHERLOCK was performed on cDNA with a 20-minute RPA reaction and 1 hour of Cas13a detection. The dashed blue line denotes the threshold for presence or absence of ZIKV (see Methods for details). (C) Comparison of SHERLOCK fluorescence to amplicon PCR yield. SHERLOCK and amplicon PCR were performed on the 40 ZIKV cDNA samples shown in (B). The amplicon PCR yield is the minimum concentration (in ng/μL) of 2 separate amplification reactions using primer pools that tile the ZIKV genome. Dashed lines denote thresholds for determining the presence or absence of ZIKV: blue for SHERLOCK, red for amplicon PCR. The Venn diagram shows the number of samples that passed these thresholds for each method. In some cases, data points are nearly superimposed, indicated by a number in parentheses. N.D.: not detected.

FIG. 83—Direct detection of ZIKV cDNA, RNA, and particles from urine. (A) Detection of ZIKV cDNA diluted in untreated healthy human urine (red) using SHERLOCK. (B) Detection of ZIKV RNA diluted in untreated (red) or treated (blue) healthy human urine using SHERLOCK. (C) Detection of ZIKV particles diluted in PBS (gray) or untreated healthy human urine (red) using SHERLOCK. Non-diluted viral stock is shown in black. Fluorescence at 3 hours for the most dilute sample and no input is shown (inset). In all panels, samples were treated with TCEP/EDTA and heated to inactivate both the virus and RNases immediately after dilution. The length of heat treatment is indicated in the schematics. Error bars indicate 1 S.D. based on 3 technical replicates.

FIG. 85—Identification of adaptive and functional ZIKV mutations from the outbreak. (A) Schematic showing how SHERLOCK assays are designed for SNP identification. Ancestral crRNAs are denoted using light colors and derived crRNAs using dark colors. (B) SHERLOCK assays for 3 SNPs from the 2016 ZIKV outbreak. Applicants show genomic locations of each of the SNPs and a simplified phylogenetic tree describing their evolutionary relationships. (C) Testing SNP identification using synthetic targets. Fluorescence values for derived crRNAs (dark colors) and ancestral crRNAs (light colors) are shown for each of the 3 region-specific SNPs. (D) Identification of region-specific SNPs in samples from the 2016 ZIKV outbreak. cDNA samples from the Dominican Republic (DOM), United States (USA), and Honduras (HND) were evaluated using the three SNP identification assays. Applicants show the fluorescence ratio (derived crRNA fluorescence divided by ancestral crRNA fluorescence) for each SNP and each sample. (E) Visualization of $\log_2$-transformed data from (D) as a heatmap. (F) Identification of a ZIKV SNP associated with microcephaly. As in (C), dark colors denote the derived crRNA and light colors denote the ancestral crRNA. In all panels, error bars indicate 1 S.D. based on 3 technical replicates.

Figure 94:
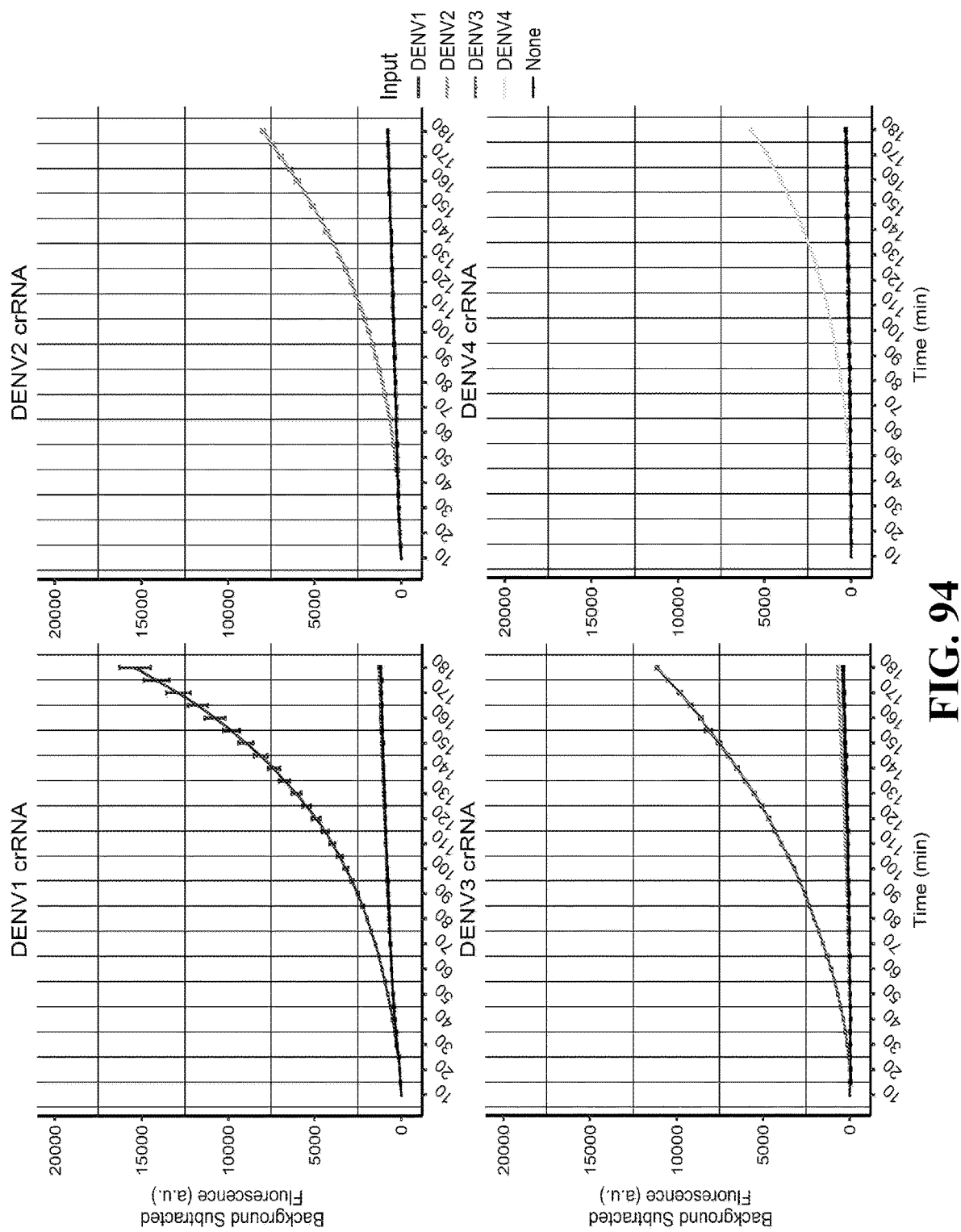

FIG. 94—Dengue panel time course. Each panel shows the background-corrected fluorescence of a DENV serotype-specific crRNA against all DENV serotypes and a no input control over a 3-hour time course with fluorescence measurements every 5 minutes. Error bars are 1 S.D. based on 3 technical replicates.

Figure 95:
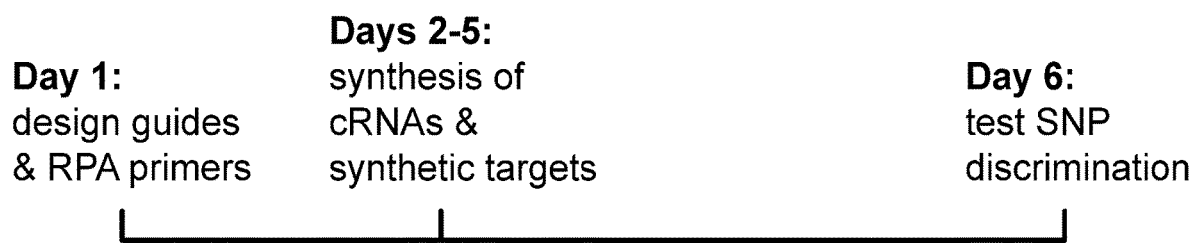

FIG. 95—SNP design timeline. Applicants show the steps required to design, build, and test a SHERLOCK-based SNP identification assay. The total turnaround time is less than 1 week.

Figure 96:
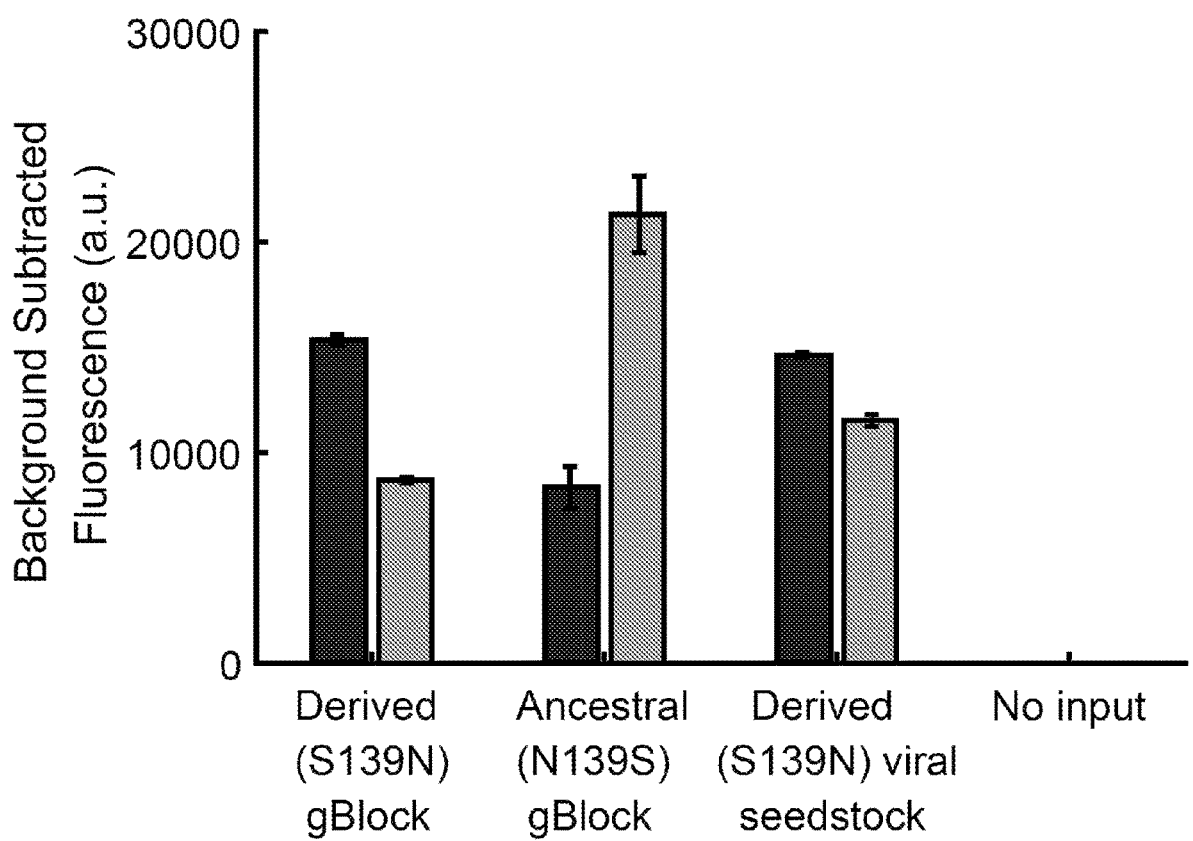

FIG. 96—ZIKV microcephaly-associated SNP discrimination with an alternative crRNA design. The SNP is in the 7th position of the crRNA, and there is no synthetic mismatch introduced into the crRNA. Dark colors denote the derived crRNA and light colors denote the ancestral crRNA. Error bars indicate 1 S.D. based on 3 technical replicates.

Figure 97:
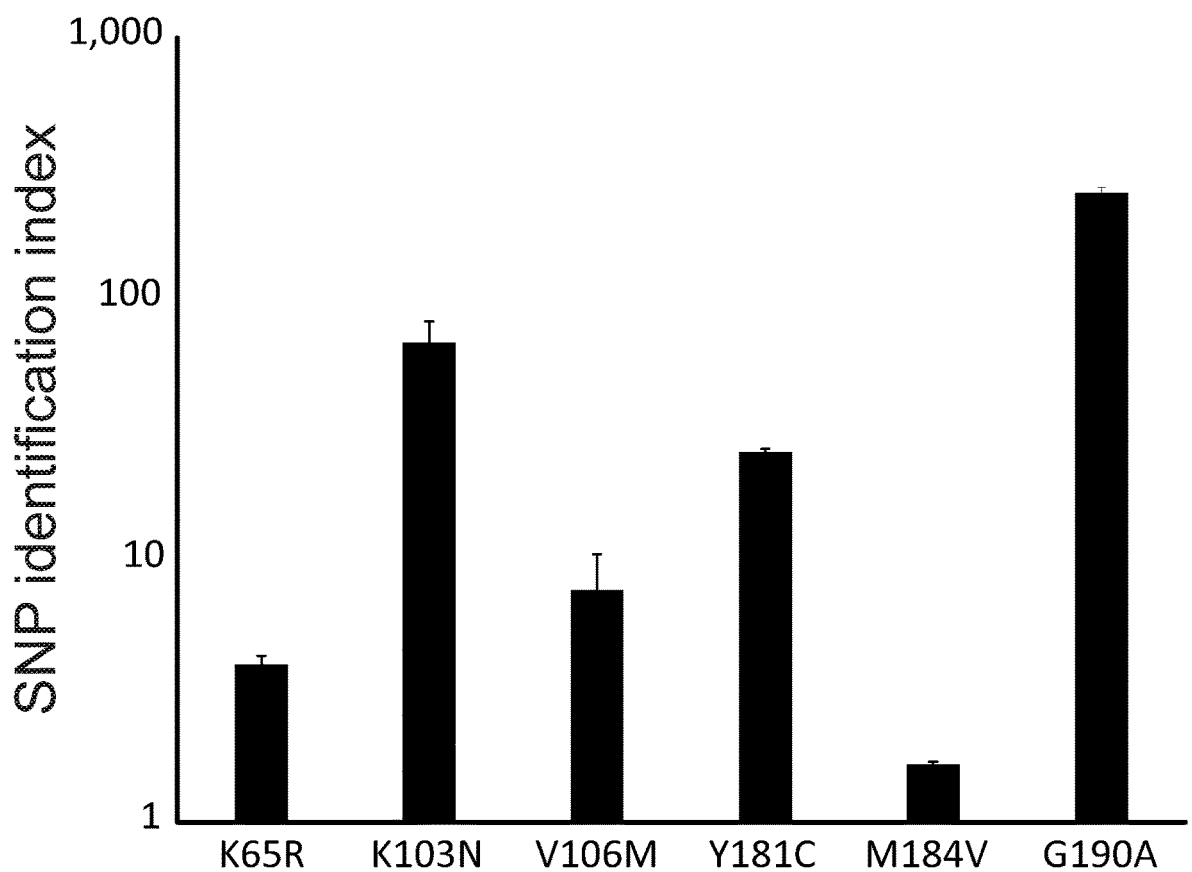

FIG. 97—SHERLOCK assays that can identify 6 drug-resistance mutations in HIV reverse transcriptase. Applicants show the SNP identification index, which is calculated by taking the fluorescence ratio for the derived template divided by the fluorescence ratio for the ancestral template (see Methods section for details). This index is equal to 1 if there is no ability to distinguish the ancestral and derived alleles and increases with increasing ability to discriminate between the two alleles. Error bars indicate 1 S.D. based on 3 technical replicates.

Figure 98:
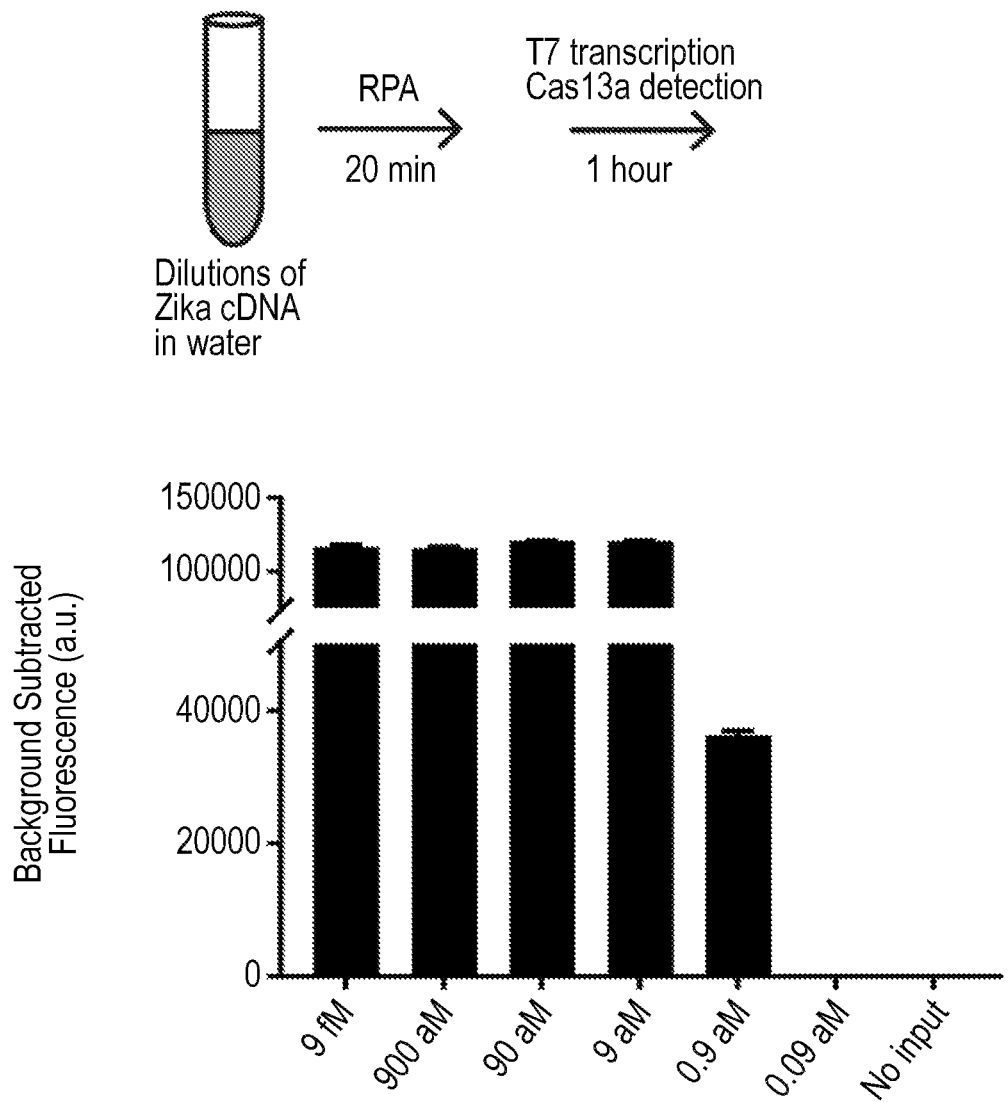

FIG. 98—illustrates that SHERLOCK can detect ZIKV cDNA with high sensitivity. Shown are SHERLOCK fluorescence values after 20 minutes of RPA and 1 hour of detection for serial dilutions of ZIKV cDNA. Sensitivity of 0.9 aM is equivalent to single copy sensitivity as 2 aM=1 cp/µl and 2 µl of sample was used as input. Error bars indicate 1 S.D. based on 3 technical replicates.

Figure 99:
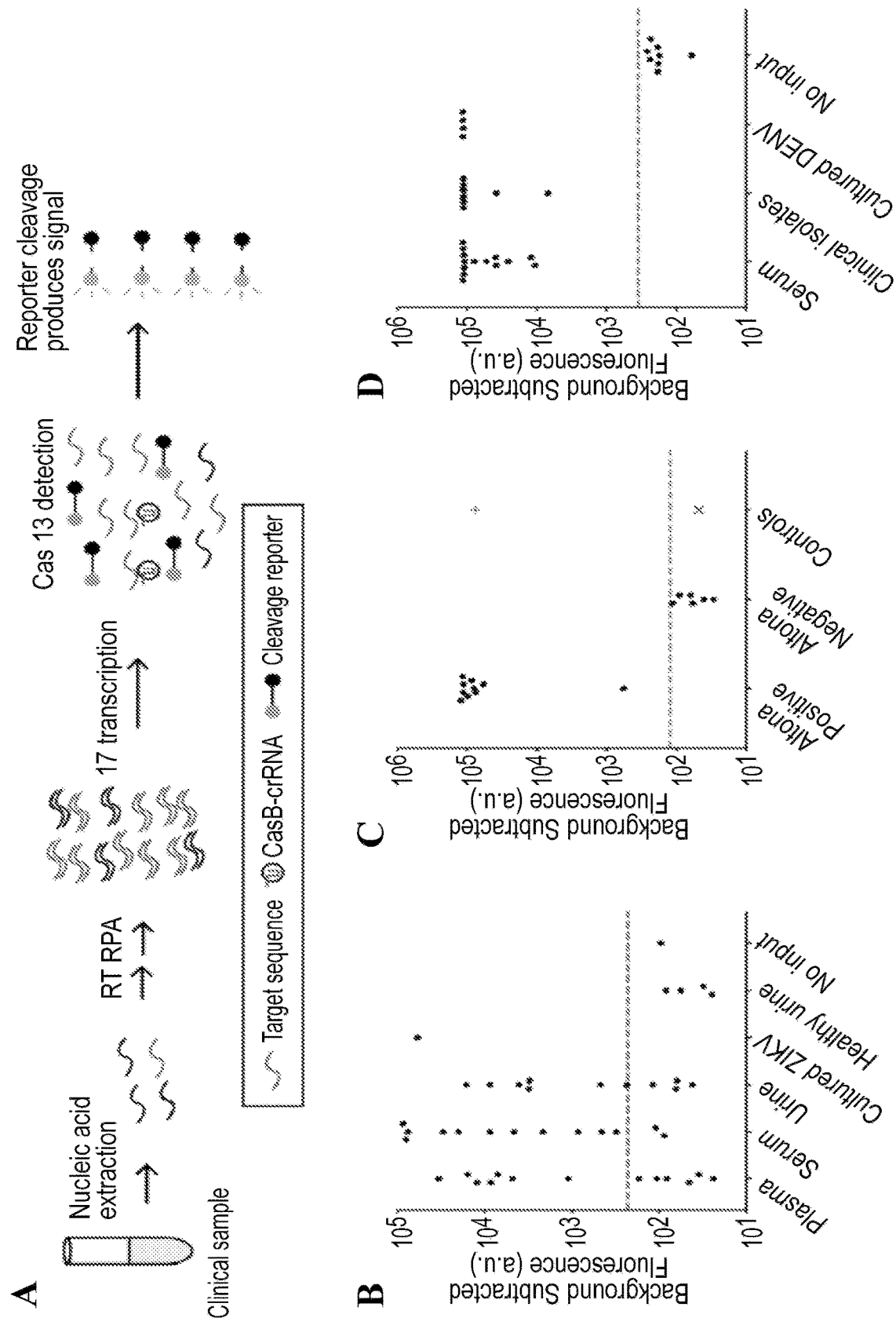

FIG. 99—shows ZIKV and DENV detection from patient samples and clinical isolates. (A) Schematic of SHERLOCK. Nucleic acid is extracted from clinical samples, and the target is amplified by RPA using either RNA or DNA as input (RT-RPA or RPA, respectively). RPA products are detected in a reaction containing T7 RNA polymerase, Cas13, a target-specific crRNA, and an RNA reporter that fluoresces when cleaved. We tested SHERLOCK on (B) cDNA derived from 37 patient samples collected during the 2015-2016 ZIKV pandemic and (C) cDNA from 16 patient samples that were compared head-to-head with the Altona RealStar Zika Virus RT-PCR assay. +: ZIKV seed stock cDNA (3×102 cp/µl) and x: no input. (D) SHERLOCK on RNA extracted from 24 DENV-positive patient samples and clinical isolates. Dashed blue line: threshold for presence or absence of ZIKV or DENV (see Methods).

Figure 100:
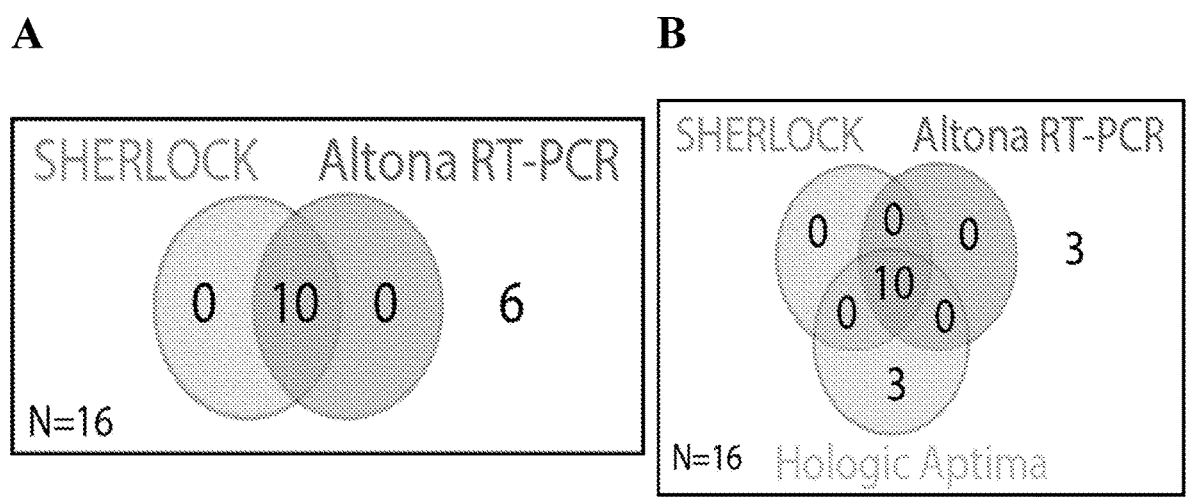

FIG. 100—shows comparison between SHERLOCK and other nucleic acid amplification tests. Shown are Venn diagrams comparing the results of (A) SHERLOCK vs. the Altona RealStar Zika Virus RT-PCR assay, and (B) SHERLOCK vs. the Altona RealStar Zika Virus RT-PCR assay and the Hologic Aptima Zika Virus assay.

Figure 101:
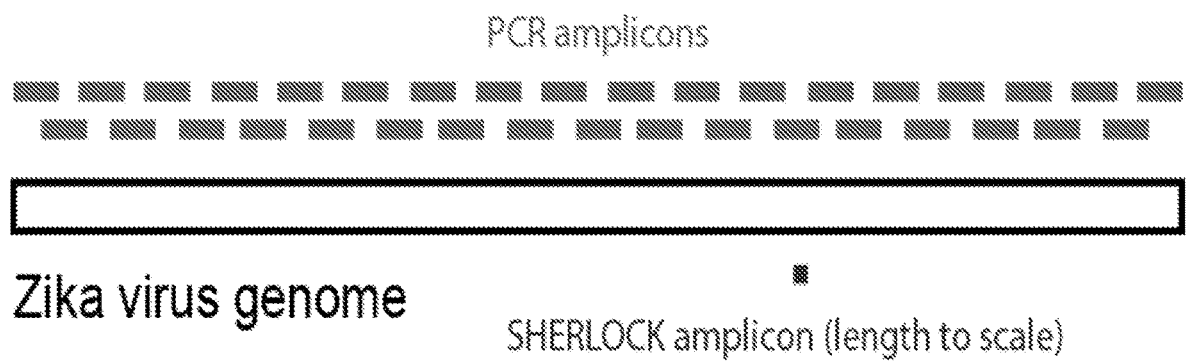

FIG. 101—Schematic of the regions of the ZIKV genome targeted by SHERLOCK and other diagnostic methods. PCR amplicons tile the entire ZIKV genome, whereas the SHERLOCK ZIKV assay targets just one region of the ZIKV genome with a shorter amplicon. The Altona RealStar RT-PCR assay and Hologic Aptima TMA assay also target individual, short amplicons in the ZIKV genome (the locations and sizes of these amplicons are proprietary and are therefore not shown in the schematic). It is possible to have a clinical sample with highly fragmented RNA which cannot be amplified by the PCR primers (which have a product length~400 nt). Conversely, it is possible to have a clinical sample with a partial ZIKV genome that does not contain the ~120 nt SHERLOCK amplicon.

Figure 102:
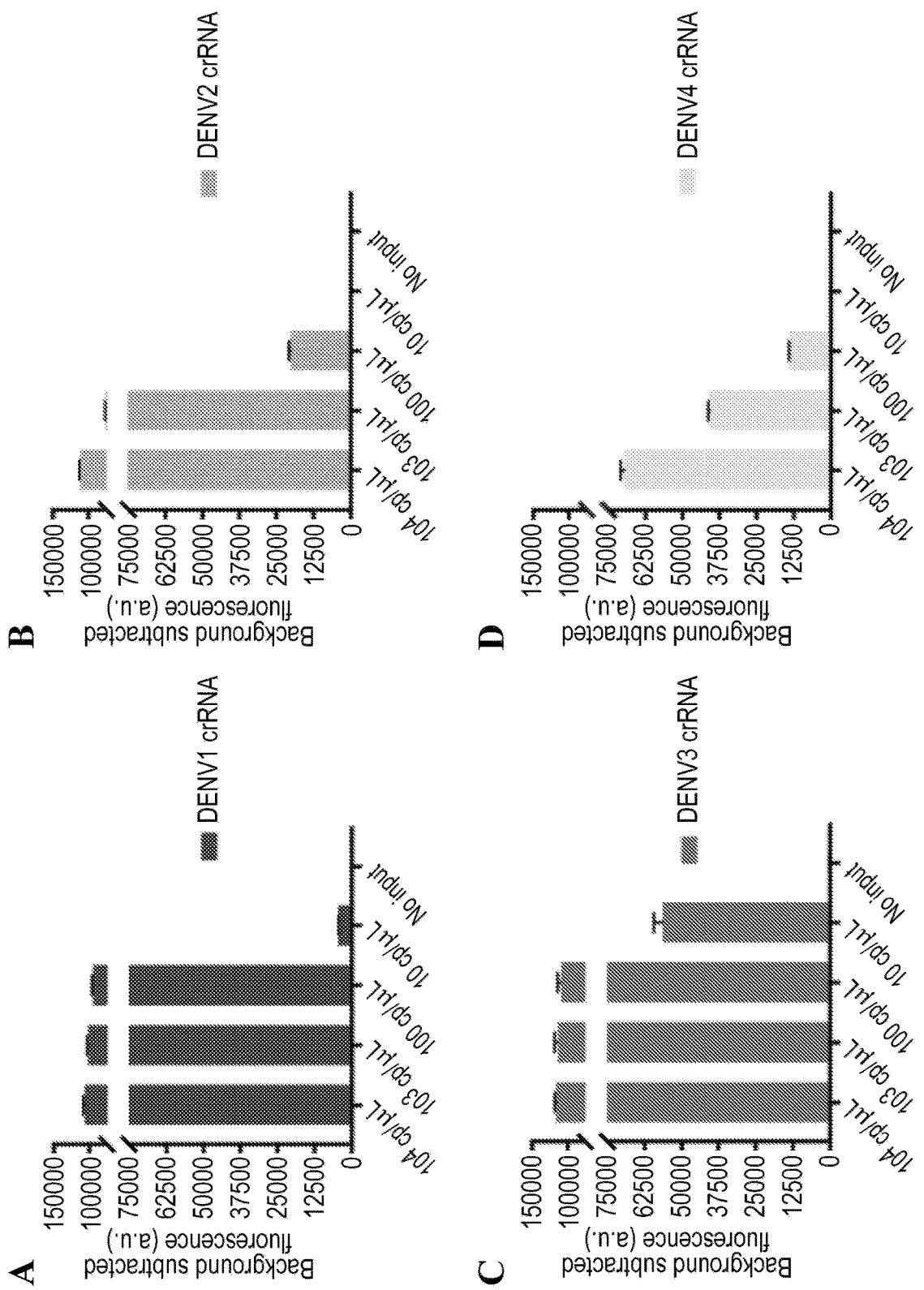

FIG. 102—shows graphs illustrating limit of detection for pan-dengue SHERLOCK on RNA from 4 DENV serotypes. (A-D) SHERLOCK fluorescence values after 20 minutes of RPA and 1 hour of detection for serial dilutions of DENV RNA derived from a synthetic template. 1 µl of sample was used as input. Error bars indicate 1 S.D. based on 3 technical replicates.

Figure 103:
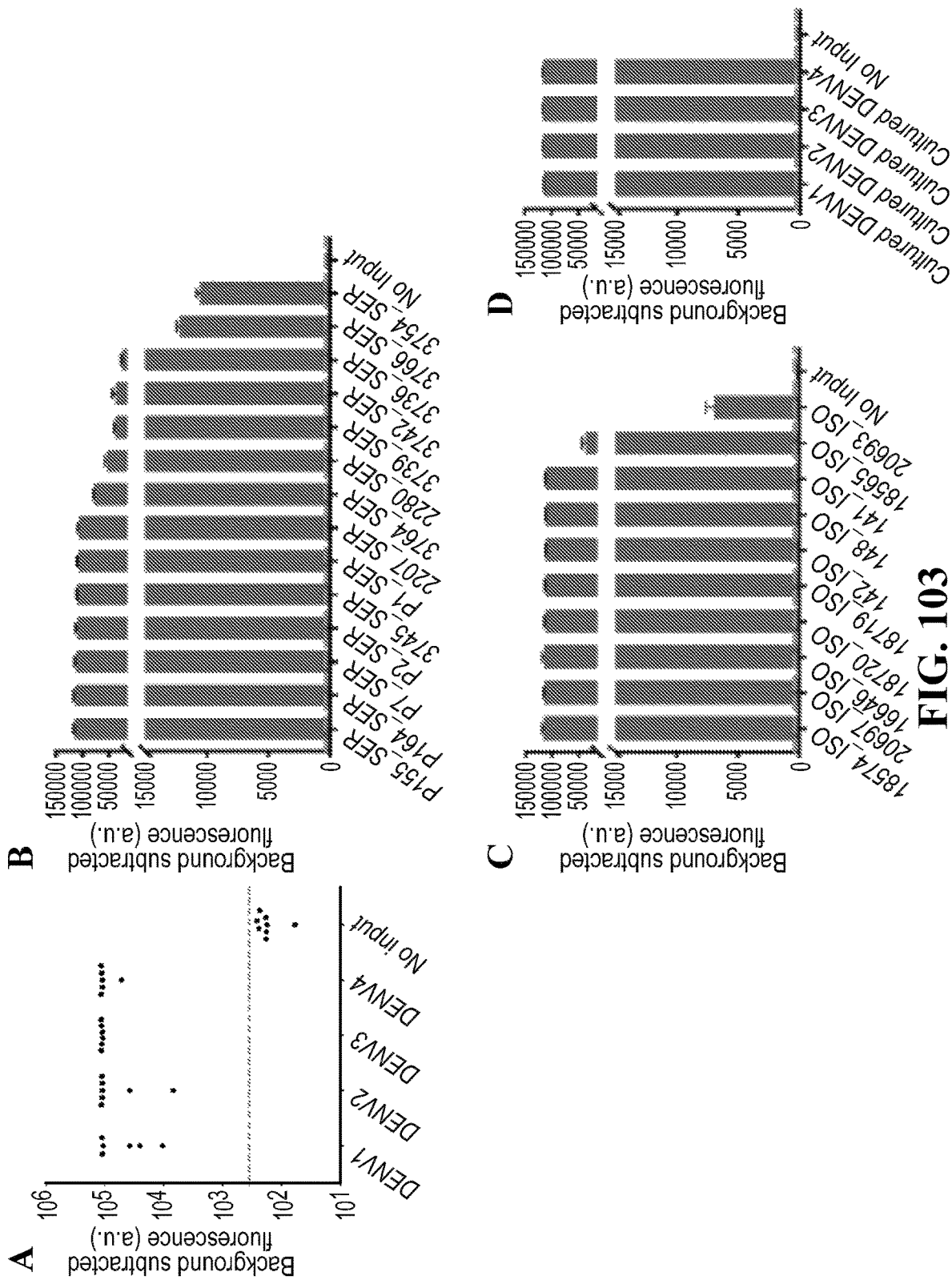

FIG. 103—illustrates pan-dengue SHERLOCK applied to patient samples and clinical isolates. (A) Pan-dengue SHERLOCK fluorescence for RNA extracted from 24 samples and 4 seed stocks denoted by DENV serotype. (B-D) Pan-dengue SHERLOCK fluorescence for RNA extracted from 14 human serum samples at 1 hour of Cas13 detection (B), 10 cultured clinical isolates at 1 hour (C), and 4 DENV seed stocks at 1 hour (D).

Figure 104:
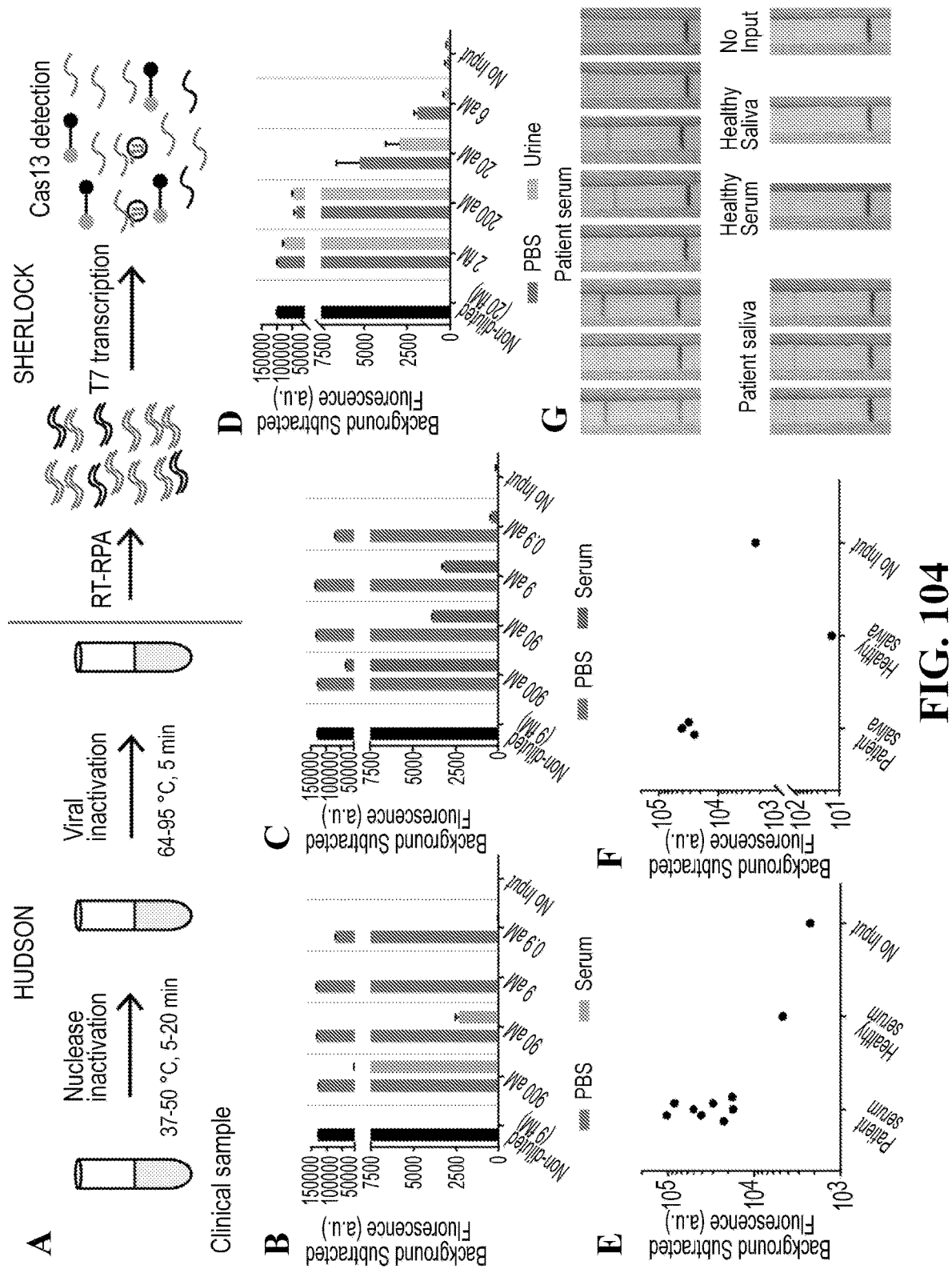

FIG. 104—Direct detection of ZIKV and DENV in bodily fluids with HUDSON and SHERLOCK. (A) Schematic of direct viral detection using HUDSON and SHERLOCK. (B-C) Detection of ZIKV RNA in particles diluted in healthy human serum (pink, B) or healthy human saliva (blue, C). Same PBS control used in A and B as experiments were performed together. (D) Detection of ZIKV RNA in particles diluted in healthy human urine (yellow). Black: non-diluted viral stock. Grey: dilutions in PBS. Error bars indicate 1 S.D. based on 3 technical replicates. (E-F) Detection of DENV RNA directly from patient serum (E) and saliva samples (F). (G) Lateral flow detection of DENV from samples shown in (E-F). All samples were treated with TCEP/EDTA prior to heating.

Figure 105:
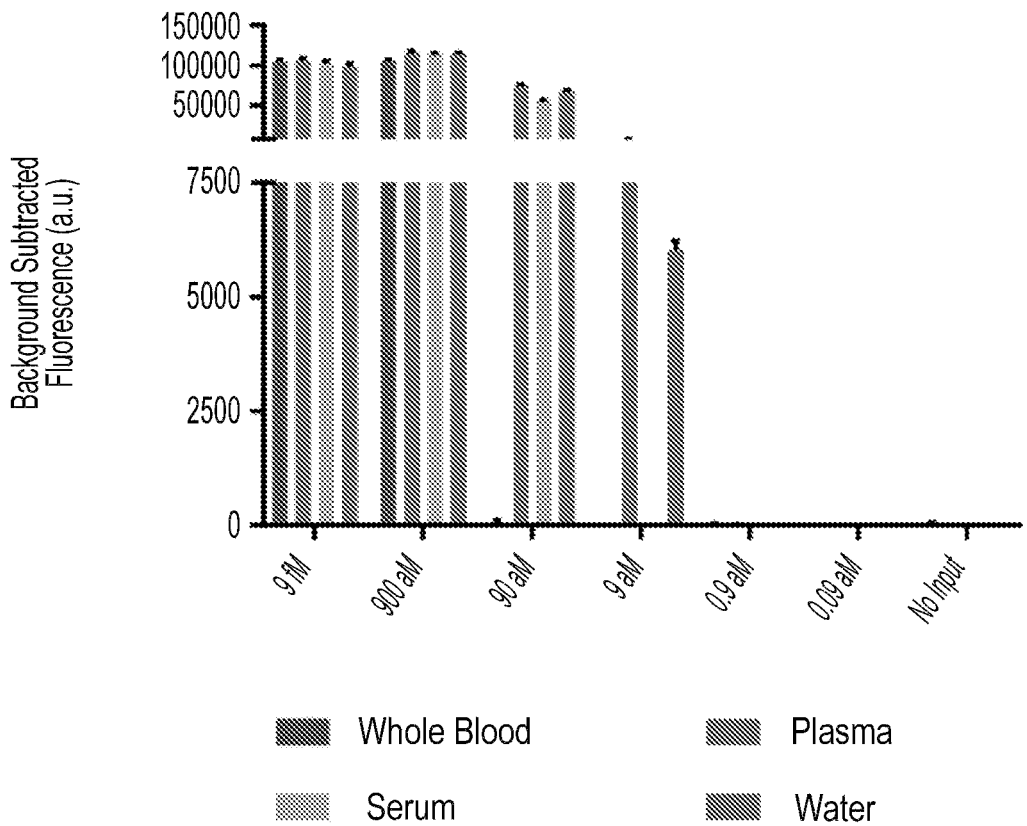

FIG. 105—shows a graph illustrating detection of ZIKV cDNA directly from blood products, with ZIKV cDNA diluted in healthy human whole blood (red), healthy human plasma (purple), healthy human serum (pink) or water (grey) using SHERLOCK. Immediately after dilution, bodily fluids were treated at 50° C. for 5 minutes, followed by 64° C. for 5 minutes with 100 mM TCEP and 1 mM EDTA. Error bars indicate 1 S.D. based on 3 technical replicates.

Figure 106:
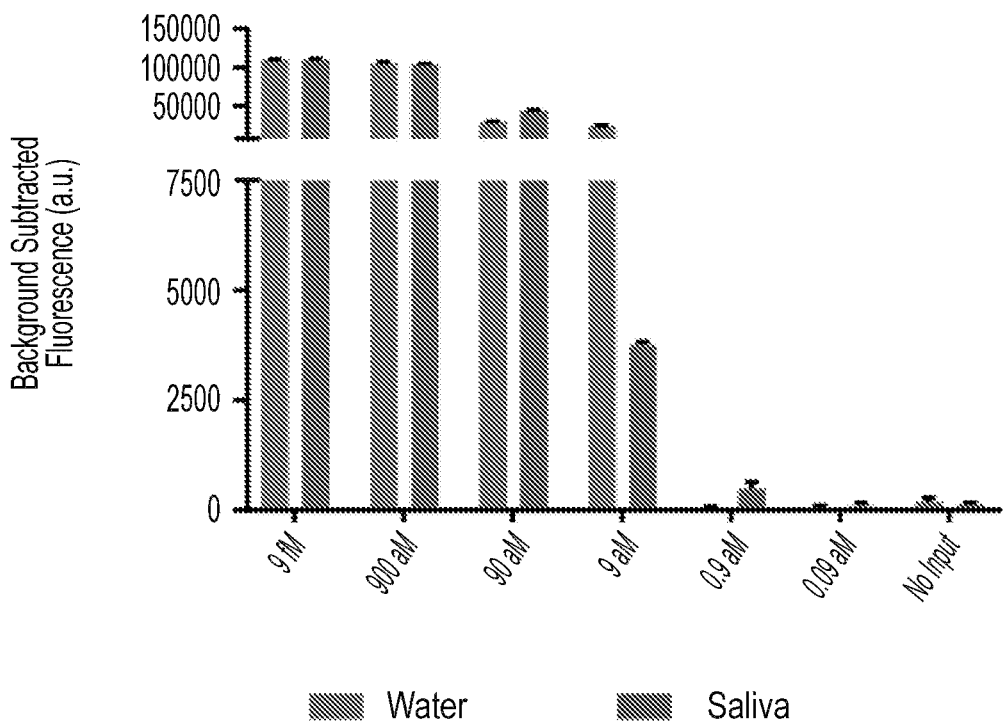

FIG. 106—shows a graph illustrating detection of ZIKV cDNA directly from saliva, with ZIKV cDNA diluted in healthy human saliva (blue) or water (grey) using SHERLOCK. Immediately after dilution, bodily fluids were treated at 50° C. for 5 minutes, followed by 64° C. for 5 minutes with 100 mM TCEP and 1 mM EDTA. Error bars indicate 1 S.D. based on 3 technical replicates.

Figure 107:
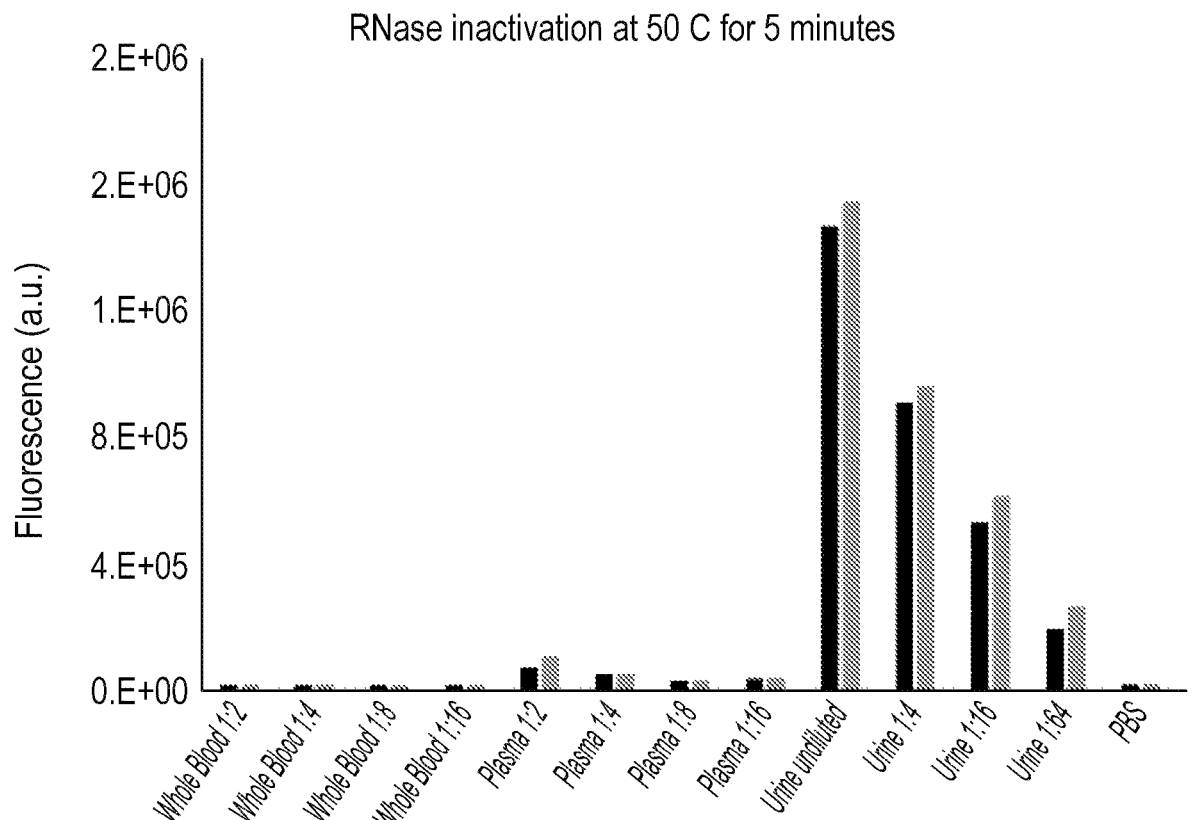

FIG. 107—shows a graph illustrating rapid RNase inactivation of whole blood, plasma, and urine. Healthy human whole blood, plasma, and urine were diluted as indicated and inactivated at 50° C. for 5 minutes with 100 mM TCEP and 1 mM EDTA. RNase activity was measured using RNase Alert v2 (Thermo) in the presence of 2 U/µl Murine RNase inhibitor (NEB) after 1 hour of incubation at 37° C. Two technical replicates are shown for each condition (orange and black bars).

Figure 108:
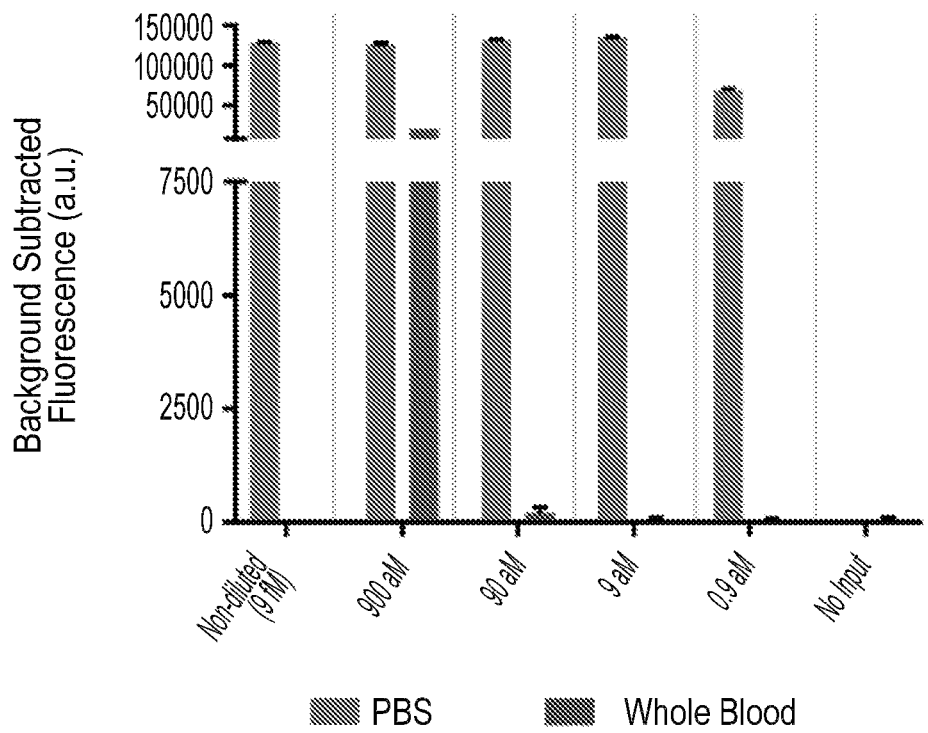

FIG. 108—graph illustrating detection of Zika virus diluted in whole blood. Detection of ZIKV RNA in particles diluted in healthy human whole blood (red) after 1 hour of detection. Samples were heated for 5 minutes at 50° C. plus 5 minutes at 64° C. with 100 mM TCEP and 1 mM EDTA. The same PBS control was used in FIG. 104A and FIG. 104B as the experiments were performed together. Error bars indicate 1 S.D. based on 3 technical replicates.

Figure 109:
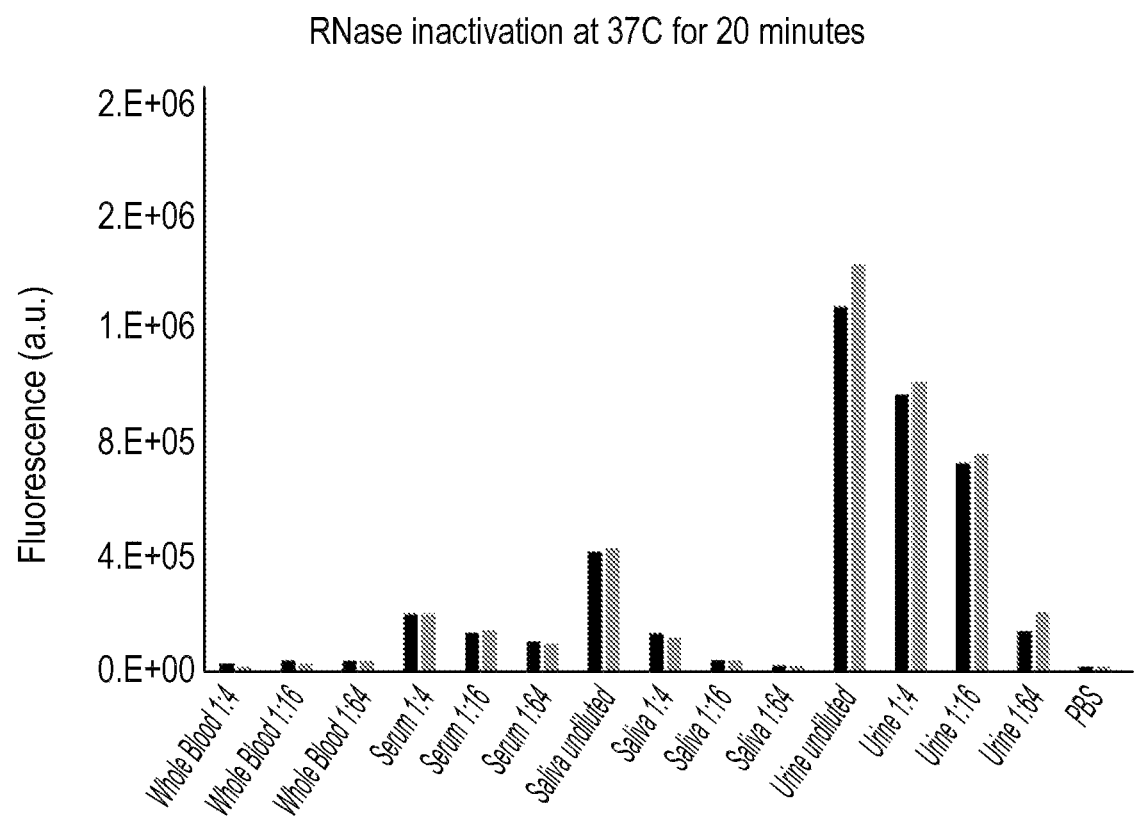

FIG. 109—graph illustrating body-temperature heat inactivation of bodily fluids. Healthy human whole blood, serum, saliva, and urine were diluted as indicated and inactivated at 37° C. for 20 minutes with 100 mM TCEP and 1 mM EDTA. RNase activity was measured using RNase Alert v2 (Thermo) in the presence of 2 U/µl Murine RNase inhibitor (NEB) after 1 hour of incubation at 37° C. Two technical replicates are shown for each condition (orange and black bars).

Figure 110:
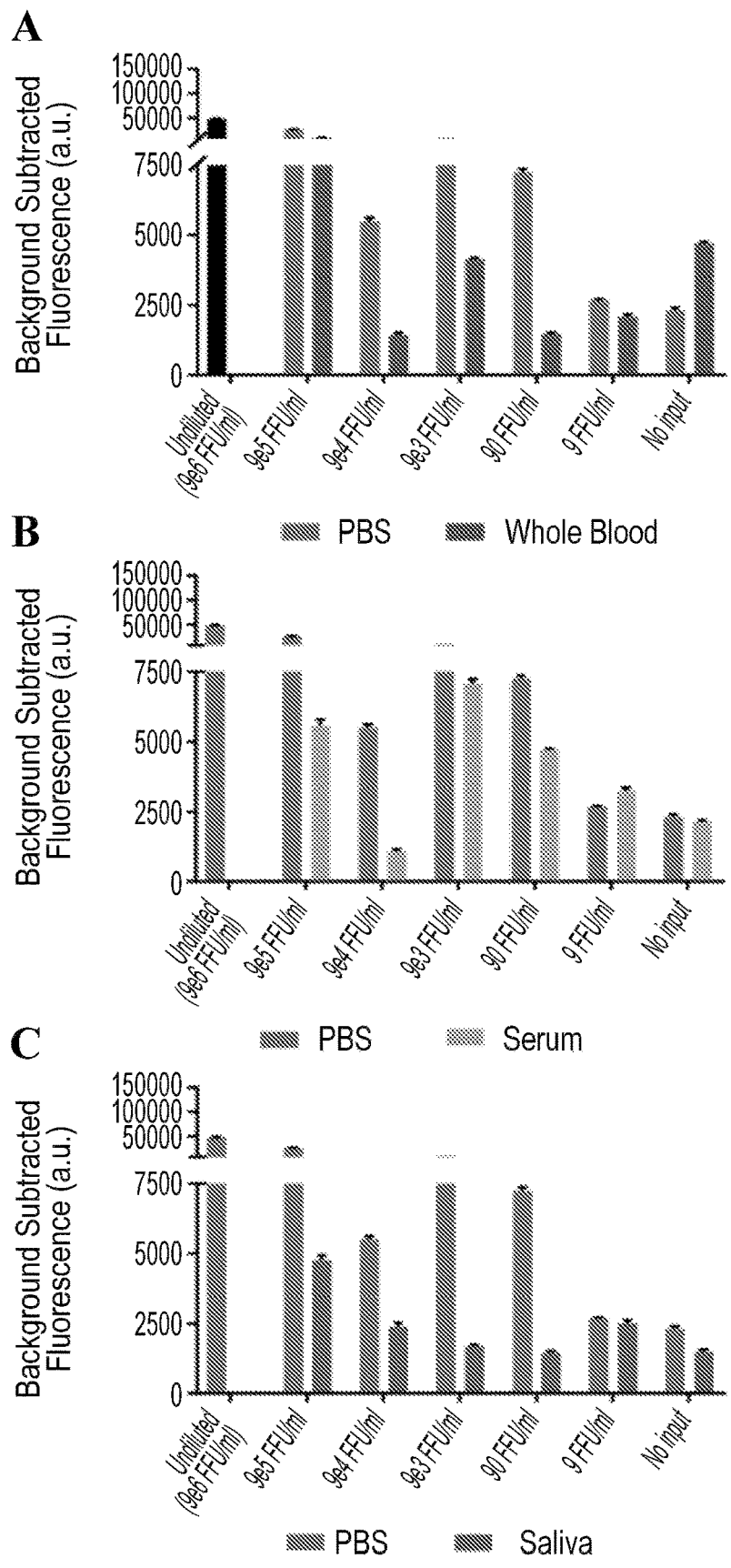

FIG. 110—graphs illustrating detection of dengue virus diluted in whole blood, serum, and saliva. Detection of DENV RNA in particles diluted in healthy human whole blood (red, A), serum (pink, B), or healthy human saliva (blue, C) after 1 hour of detection. Samples were heated for 20 minutes at 37° C. plus 5 minutes at 64° C. for inactivation with 100 mM TCEP and 1 mM EDTA. The same PBS controls used in all panels as the experiments were performed together. DENV titers in focus-forming units per ml (FFU/ml) are indicated. Error bars indicate 1 S.D. based on 3 technical replicates.

Figure 111:
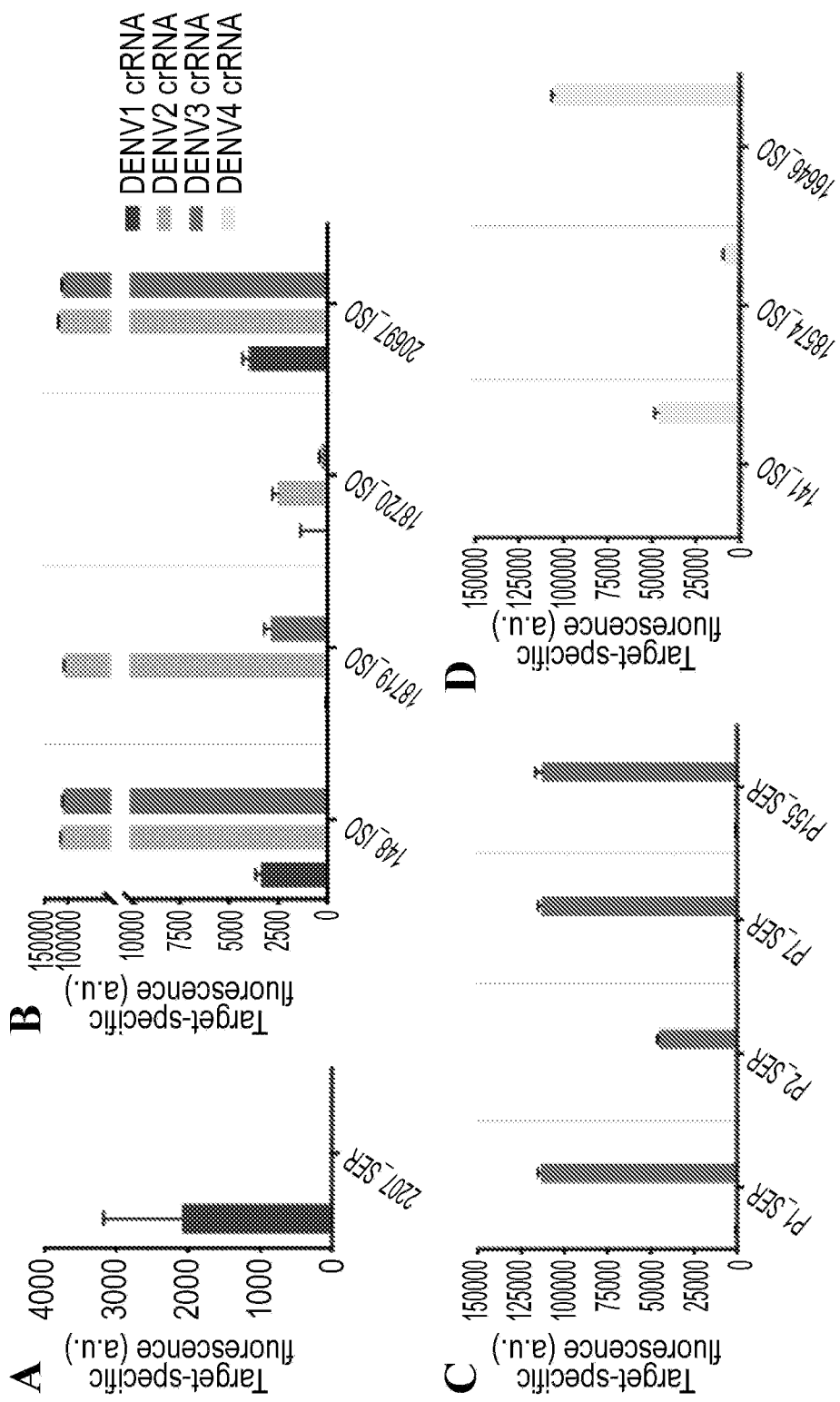

FIG. 111—shows bar plots of Dengue clinical sample RNA serotypes. (A-D) SHERLOCK DENV panel for differentiating serotypes tested with extracted RNA from 1 DENV1 sample (A), 2 DENV2 samples and 2 samples with presence of DENV2 and DENV3 (B), 4 DENV3 samples (C), and 3 DENV4 samples (D). Fluorescence values are shown after 3 hours of Cas13 detection. Error bars indicate 1 S.D. based on 3 technical replicates.

Figure 112:
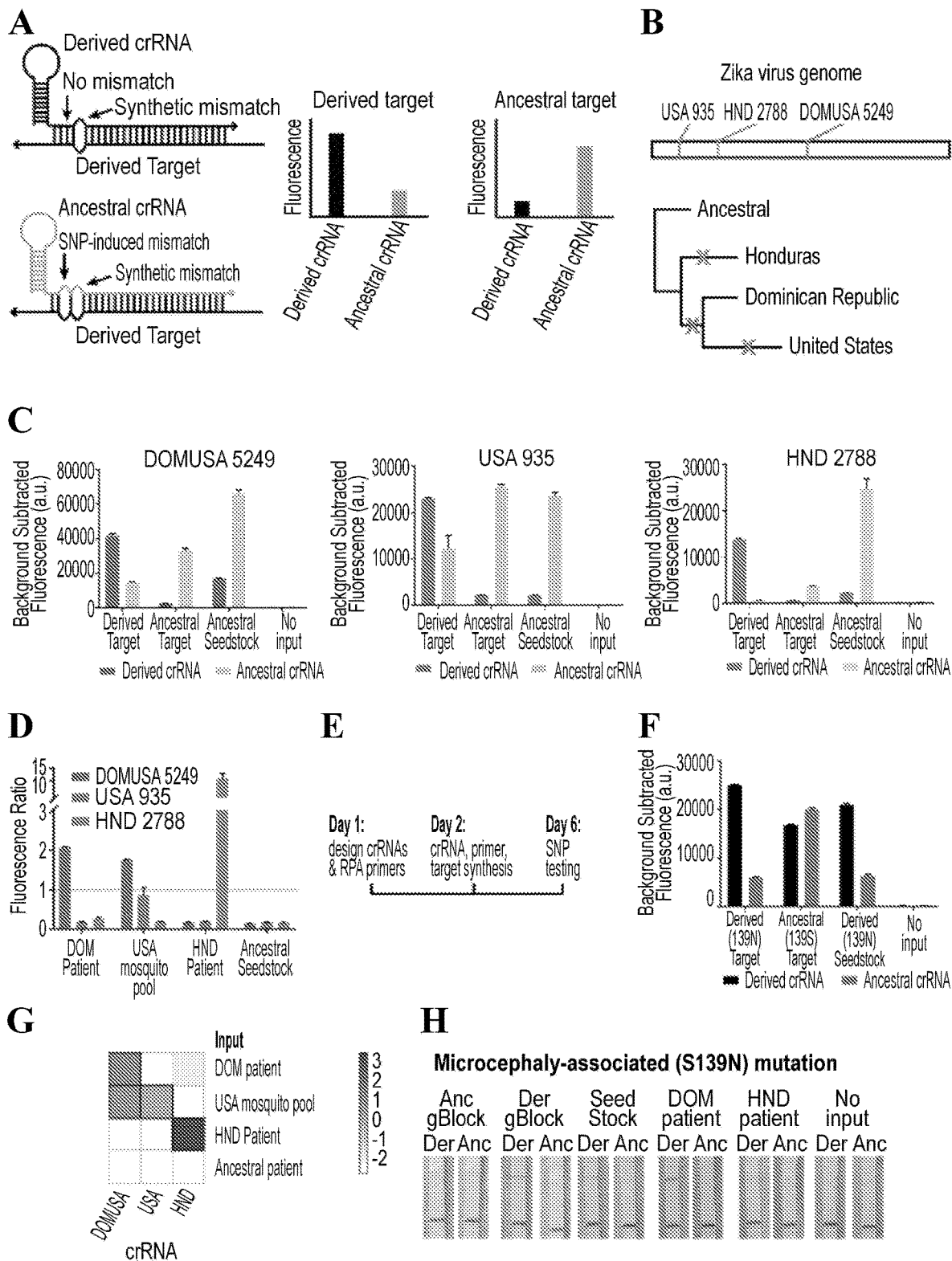

FIG. 112—illustrates identification of adaptive and functional ZIKV mutations. (A) SHERLOCK assays for SNP identification. Dark colors: derived crRNAs, light colors: ancestral crRNAs. (B-C) Three region-specific SNPs from the 2015-2016 ZIKV pandemic, including genomic locations of the SNPs and a simplified phylogenetic tree, tested using synthetic targets (104 cp/µl) and viral seedstock cDNA ($3\times10^2$ cp/µl). (D-E) Identification of region-specific SNPs in ZIKV cDNA samples from the Dominican Republic (DOM), United States (USA), and Honduras (HND). The fluorescence ratio (derived crRNA fluorescence divided by ancestral crRNA fluorescence) for each SNP in each sample is shown in a bar plot (log 2-transformed data in a heatmap). (F) Timeline for developing a SHERLOCK assay for a new SNP (more detail in FIG. 113). (G-H) Identification of a microcephaly-associated ZIKV mutation (PrM S139N) by fluorescent and colorimetric detection. In all panels, error bars indicate 1 S.D. based on 3 technical replicates.

Figure 113:
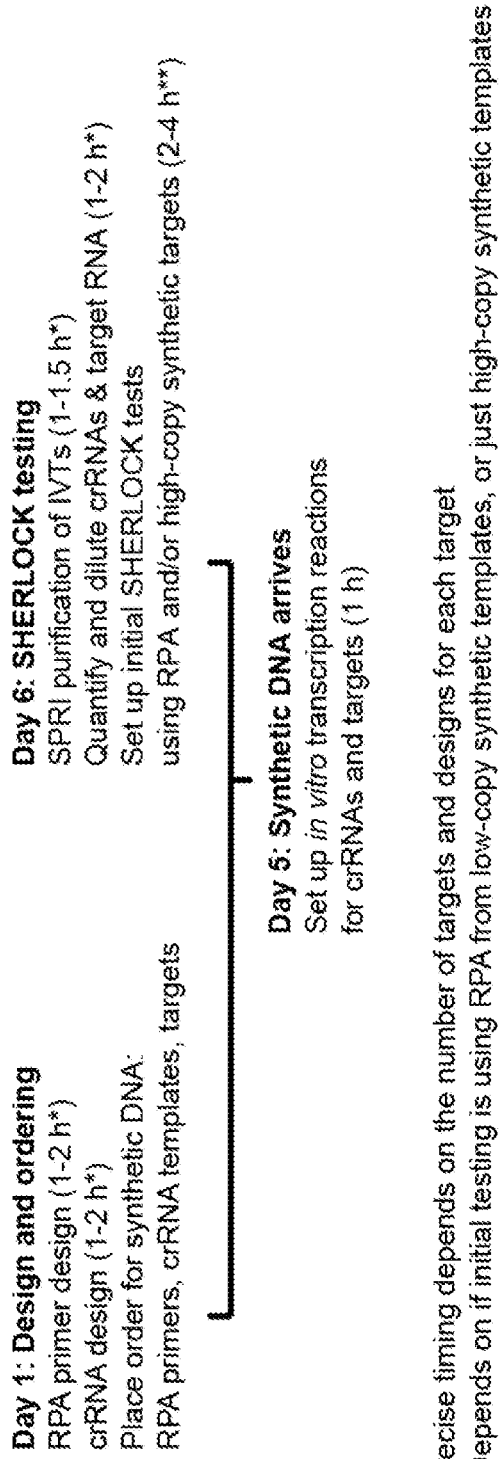

FIG. 113—illustrates the SNP design timeline. We show the steps required to design, build, and test a SHERLOCK-based SNP identification assay, along with the hands-on time required for each step. The total turnaround time is less than 1 week.

Figure 114:
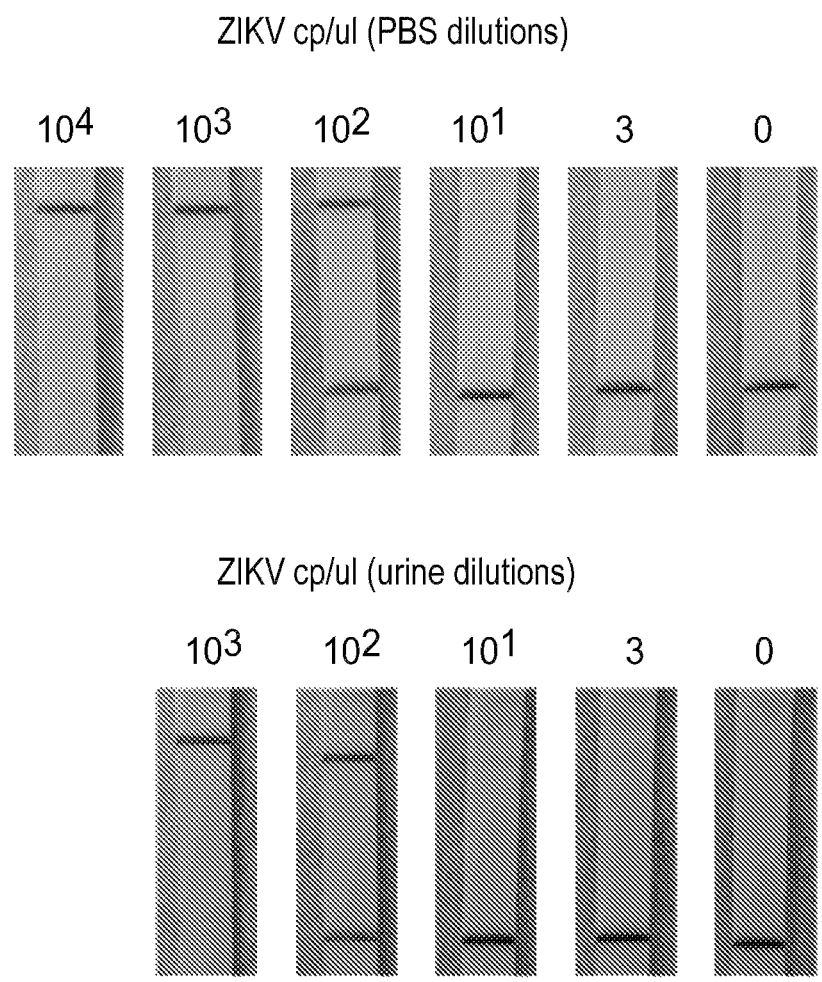

FIG. 114—illustrates lateral flow detection of Zika virus diluted in urine with a visual readout. We show lateral flow detection of Zika virus diluted in urine (FIG. 104C). The top band is the test band, and the bottom band is the control band. A faint band is visible at 10 copies per microliter in both PBS and urine dilutions after 1 hour of detection.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a" "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment but may. Furthermore, the particular features, structures or characteristics may be combined in any suitable manner, as would be apparent to a person skilled in the art from this disclosure, in one or more embodiments. Furthermore, while some embodiments described herein include some, but not other, features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

Microbial Clustered Regularly Interspaced Short Palindromic Repeats (CRISPR) and CRISPR-associated (CRISPR-Cas) adaptive immune systems contain programmable endonucleases, such as Cas9 and Cpf1 (Shmakov et al., 2017; Zetsche et al., 2015). Although both Cas9 and Cpf1 target DNA, single effector RNA-guided RNases have been recently discovered (Shmakov et al., 2015) and characterized (Abudayyeh et al., 2016; Smargon et al., 2017), including C2c2, providing a platform for specific RNA sensing. RNA-guided RNases can be easily and conveniently reprogrammed using CRISPR RNA (crRNAs) to cleave target RNAs. Unlike the DNA endonucleases Cas9 and Cpf1, which cleave only its DNA target, RNA-guided RNases, like C2c2, remains active after cleaving its RNA target, leading to "collateral" cleavage of non-targeted RNAs in proximity (Abudayyeh et al., 2016). This crRNA-programmed collateral RNA cleavage activity presents the opportunity to use RNA-guided RNases to detect the presence of a specific RNA by triggering in vivo programmed cell death or in vitro nonspecific RNA degradation that can serve as a readout (Abudayyeh et al., 2016; East-Seletsky et al., 2016).

The embodiments disclosed herein utilized RNA targeting effectors to provide a robust CRISPR-based diagnostic with attomolar sensitivity. Embodiments disclosed herein can detect broth DNA and RNA with comparable levels of sensitivity and can differentiate targets from non-targets based on single base pair differences. Moreover, the embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA.

To diagnose infectious microbes around the world, there is a need for assays that are fast, sensitive, low-cost, user-friendly, and rapidly adaptable to detect newly-identified agents. The embodiments disclosed herein demonstrate the Cas13-based SHERLOCK platform can detect Zika virus (ZIKV) in clinical samples and mosquito pools with single-copy sensitivity and show it can detect ZIKV directly from urine in <2 hours. Applicants further developed assays to simultaneously detect 4 Flaviviruses, to differentiate between Dengue virus serotypes 1-4, and to distinguish strains of ZIKV from the 2016 outbreak using region-specific variants. Finally, Applicants developed and tested an assay to identify a ZIKV variant associated with fetal microcephaly within 1 week of its publication. This demonstrates that SHERLOCK can detect viruses directly from bodily fluids, distinguish multiple pathogenic viruses, and can rapidly be updated to identify mutations responsible for clinically important phenotypes.

In one aspect, the embodiments disclosed herein are directed to a nucleic acid detection system comprising a CRISPR system, one or more guide RNAs designed to bind to corresponding target molecules, a masking construct, and optional amplification reagents to amplify target nucleic acid molecules in a sample. In certain example embodiments, the system may further comprise one or more detection aptamers. The one or more detection aptamers may comprise an RNA polymerase site or primer binding site. The one or more detection aptamers specifically bind one or more target polypeptides and are configured such that the RNA polymerase site or primer binding site is exposed only upon binding of the detection aptamer to a target peptide. Exposure of the RNA polymerase site facilitates generation of a trigger RNA oligonucleotide using the aptamer sequence as a template. Accordingly, in such embodiments the one or more guide RNAs are configured to bind to a trigger RNA.

In another aspect, the embodiments disclosed herein are directed to a diagnostic device comprising a plurality of individual discrete volumes. Each individual discrete volume comprises a CRISPR effector protein, one or more guide RNAs designed to bind to a corresponding target molecule, and a masking construct. In certain example embodiments, RNA amplification reagents may be pre-loaded into the individual discrete volumes or be added to the individual discrete volumes concurrently with or subsequent to addition of a sample to each individual discrete volume. The device may be a microfluidic based device, a wearable device, or device comprising a flexible material substrate on which the individual discrete volumes are defined.

In another aspect, the embodiments disclosed herein are directed to a method for detecting target nucleic acids in a sample comprising distributing a sample or set of samples into a set of individual discrete volumes, each individual discrete volume comprising a CRISPR effector protein, one or more guide RNAs designed to bind to one target oligonucleotides, and a masking construct. The set of samples are then maintained under conditions sufficient to allow binding of the one or more guide RNAs to one or more target molecules. Binding of the one or more guide RNAs to a target nucleic acid in turn activates the CRISPR effector protein. Once activated, the CRISPR effector protein then deactivates the masking construct, for example, by cleaving the masking construct such that a detectable positive signal is unmasked, released, or generated. Detection of the positive detectable signal in an individual discrete volume indicates the presence of the target molecules.

In yet another aspect, the embodiments disclosed herein are directed to a method for detecting polypeptides. The method for detecting polypeptides is similar to the method for detecting target nucleic acids described above. However, a peptide detection aptamer is also included. The peptide detection aptamers function as described above and facilitate generation of a trigger oligonucleotide upon binding to a target polypeptide. The guide RNAs are designed to recognize the trigger oligonucleotides thereby activating the CRISPR effector protein. Deactivation of the masking construct by the activated CRISPR effector protein leads to unmasking, release, or generation of a detectable positive signal.

Crispr Effector Proteins

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g., tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g., CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required. C2c2 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023., which is incorporated herein in its entirety by reference.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U. In certain embodiments, the effector protein may be *Leptotrichia shahii* C2c2p, more preferably *Leptotrichia shahii* DSM 19757 C2c2, and the 3' PAM is a 5' H.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

The nucleic acid molecule encoding a CRISPR effector protein, in particular C2c2, is advantageously codon optimized CRISPR effector protein. An example of a codon optimized sequence is, in this instance, a sequence optimized for expression in eukaryotes, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal including, but not limited to, human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell, in particular a C2c2 transgenic cell, in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also, the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In certain aspects the invention involves vectors, e.g., for delivering or introducing in a cell Cas and/or RNA capable of guiding Cas to a target locus (i.e., guide RNA), but also for propagating these components (e.g., in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004, as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words, samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well-established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner (see, e.g., nar.oxfordjournals. org/content/34/7/e53.short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the 3-actin promoter, the phosphoglycerol kinase (PGK) promoter, and the EF1α promoter. An advantageous promoter is the promoter is U6.

In some embodiments, one or more elements of a nucleic acid-targeting system is derived from a particular organism comprising an endogenous CRISPR RNA-targeting system. In certain example embodiments, the effector protein CRISPR RNA-targeting system comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the effector protein comprises a single HEPN domain. In certain other example embodiments, the effector protein comprises two HEPN domains.

In one example embodiment, the effector protein comprises one or more HEPN domains comprising a RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application entitled "Novel Type VI CRISPR Orthologs and Systems," and filed on Apr. 12, 2017.

In an embodiment of the invention, a HEPN domain comprises at least one RxxxxH motif comprising the sequence of R{N/H/K}X1X2X3H. In an embodiment of the invention, a HEPN domain comprises a RxxxxH motif comprising the sequence of R{N/H}X1X2X3H. In an embodiment of the invention, a HEPN domain comprises the sequence of R{N/K}X1X2X3H. In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In certain example embodiments, the C2c2 effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related or are only partially structurally related. An "orthologue" of a protein as used herein is a protein of a different species which performs the same or a similar function as the protein it is an orthologue of. Orthologous proteins may but need not be structurally related or are only partially structurally related.

In particular embodiments, the Type VI RNA-targeting Cas enzyme is C2c2. In other example embodiments, the Type VI RNA-targeting Cas enzyme is Cas 13b. In particular embodiments, the homologue or orthologue of a Type VI protein such as C2c2 as referred to herein has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as C2c2 (e.g., based on the wild-type sequence of any of *Leptotrichia shahii* C2c2, Lachnospiraceae *bacterium* MA2020 C2c2, Lachnospiraceae *bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae *bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2). In further embodiments, the homologue or orthologue of a Type VI protein such as C2c2 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type C2c2 (e.g., based on the wild-type sequence of any of *Leptotrichia shahii* C2c2, Lachnospiraceae *bacterium* MA2020 C2c2, Lachnospiraceae *bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae *bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2).

In certain other example embodiments, the CRISPR system the effector protein is a C2c2 nuclease. The activity of C2c2 may depend on the presence of two HEPN domains. These have been shown to be RNase domains, i.e., nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR systems, reference is made to U.S. Provisional 62/351,662 filed on Jun. 17, 2016, and U.S. Provisional 62/376,377 filed on Aug. 17, 2016. Reference is also made to U.S. Provisional 62/351,803 filed on Jun. 17, 2016. Reference is also made to U.S. Provisional entitled "Novel Crispr Enzymes and Systems" filed Dec. 8, 2016, bearing Broad Institute No. 10035.PA4. Reference is further made to East-Seletsky et al. "Two distinct RNase activities of CRISPR-C2c2 enable guide-RNA processing and RNA detection" Nature doi:10/1038/nature19802 and Abudayyeh et al. "C2c2 is a single-component programmable RNA-guided RNA targeting CRISPR effector" bioRxiv doi:10.1101/054742.

RNase function in CRISPR systems is known, for example mRNA targeting has been reported for certain type III CRISPR-Cas systems (Hale et al., 2014, *Genes Dev*, vol. 28, 2432-2443; Hale et al., 2009, *Cell*, vol. 139, 945-956; Peng et al., 2015, *Nucleic acids research*, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a C2c2 ortholog of an organism of a genus which includes but is not limited to *Leptotrichia, Listeria*, Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologues of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria*, Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein.

In an embodiment, nucleic acid molecule(s) encoding the C2c2 or an ortholog or homolog thereof, may be codon-optimized for expression in a eukaryotic cell. A eukaryote can be as herein discussed. Nucleic acid molecule(s) can be engineered or non-naturally occurring.

In an embodiment, the C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the C2c2 or an ortholog or homolog thereof, may be used as a generic nucleic acid binding protein with fusion to or being operably linked to a functional domain. Exemplary functional domains may include, but are not limited to, translational initiator, translational activator, translational repressor, nucleases, in particular ribonucleases, a spliceosome, beads, a light inducible/controllable domain or a chemically inducible/controllable domain.

In certain example embodiments, the C2c2 effector protein may be from an organism selected from the group consisting of; *Leptotrichia, Listeria*, Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma*, and *Campylobacter*.

In certain embodiments, the effector protein may be a *Listeria* sp. C2c2p, preferably *Listeria* seeligeria C2c2p, more preferably *Listeria* seeligeria serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a *Leptotrichia* sp., *Leptotrichia wadei* F0279, or a *Listeria* sp., preferably *Listeria newyorkensis* FSL M6-0635.

In certain example embodiments, the C2c2 effector proteins of the invention include, without limitation, the following 21 ortholog species (including multiple CRISPR loci: *Leptotrichia shahii*; *Leptotrichia wadei* (Lw2); *Listeria seeligeri*; Lachnospiraceae *bacterium* MA2020; Lachnospiraceae *bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae *bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; Eubacteriaceae *bacterium* CHKCI004; *Blautia* sp. *Marseille*-P2398; and *Leptotrichia* sp. oral taxon 879 str. F0557. Twelve (12) further non-limiting examples are: Lachnospiraceae *bacterium* NK4A144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. *Marseille*-P2398; *Leptotrichia* sp. *Marseille*-P3007; *Bacteroides ihuae*; Porphyromonadaceae *bacterium* KH3CP3RA; *Listeria riparia*; and *Insolitispirillum peregrinum*.

In certain embodiments, the C2c2 protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead C2c2, split C2c2, destabilized C2c2, etc. as defined herein elsewhere, with or without fusion with a heterologous/functional domain.

In certain example embodiments, the C2c2 effector protein is selected from Table 1 below. (SEQ. ID. Nos. 600-615 also included)

TABLE 1

| C2c2 orthologue | Code | Multi Letter |
| --- | --- | --- |
| *Leptotrichia shahii* (SEQ ID. No. 580) | C2-2 | Lsh |
| *L. wadei* F0279 (Lw2) (SEQ I.D. No. 581) | C2-3 | Lw2 |
| *Listeria seeligeri* (SEQ I.D. No. 582) | C2-4 | Lse |
| Lachnospiraceae bacterium MA2020 (SEQ I.D. No. 583) | C2-5 | LbM |
| Lachnospiraceae bacterium NK4A179 (SEQ I.D. No. 584) | C2-6 | LbNK179 |
| Clostridium aminophilum DSM 10710 (SEQ I.D. No. 585) | C2-7 | Ca |
| Carnobacterium gallinarum DSM 4847 (SEQ I.D. No. 586) | C2-8 | Cg |
| Carnobacterium gallinarum DSM 4847 (SEQ I.D. No. 587 | C2-9 | Cg2 |
| Paludibacter propionicigenes WB4 (SEQ I.D. No. 588) | C2-10 | Pp |
| Listeria weihenstephanensis FSL R9-0317 (SEQ I.D. No. X589 | C2-11 | Lwei |
| Listeriaceae bacterium FSL M6-0635 (SEQ I.D. No. 590) | C2-12 | LbFSL |
| Leptotrichia wadei F0279 (SEQ I.D. No. 591) | C2-13 | Lw |
| Rhodobacter capsulatus SB 1003 (SEQ I.D. No. 592) | C2-14 | Rc |
| Rhodobacter capsulatus R121 (SEQ I.D. No. 593) | C2-15 | Rc |
| Rhodobacter capsulatus DE442 (SEQ I.D. No. 594) | C2-16 | Rc |
| Leptotrichia buccalis C-1013-b (SEQ I.D. No. 595) | C2-17 | LbuC2c2 |
| Herbinix hemicellulosilytics (SEQ I.D. No. 596) | C2-18 | HheC2c2 |
| Eubacterium rectale (SEQ I.D. No. 597) | C2-19 | EreC2c2 |
| Eubacteriaceae bacterium CHKCI004 (SEQ I.D. No. 598) | C2-20 | EbaC2c2 |
| Blautia sp. Marseille-P2398 (SEQ I.D. No. 599) | C2-21 | BsmC2c2 |
| Leptotrichia sp. oral taxon 879 str. F0557 (SEQ I.D. No. 579) | C2-22 | LspC2c2 |
| Lachnospiraceae bacterium NK4a144 (SEQ I.D. No. 313) | | |
| Chloroflexus aggregans (SEQ. I.D. No. 314) | | |
| Demequina aurantiaca (SEQ. I.D. No. 315) | | |
| Thalassospira sp. TSL5-1 (SEQ. I.D. No. 316) | | |
| Pseudobutyrivibrio sp. OR37 (SEQ. I.D. No. 317) | | |
| Butyrivibrio sp. YAB3001 (SEQ. I.D. No. 318) | | |
| Blautia sp. Marseille-P2398 (SEQ. I.D. No. 478) | | |
| Leptotrichia sp. Marseille-P300 (SEQ. I.D. No. 320) | | |
| Bacteroides ihuae (SEQ. I.D. No. 321) | | |
| Porphyromonadaceae bacterium KH3CP3RA (SEQ. I.D. No. 322) | | |
| Listeria riparia (SEQ. I.D. No. 323) | | |
| Insolitispirillum peregrinum (SEQ. I.D. No. 324) | | |

The wild type protein sequences of the above species are listed in Table 2 below. In certain embodiments, a nucleic acid sequence encoding the C2c2 protein is provided.

TABLE 2

| | |
| --- | --- |
| C2c2-2 | *L. shahii* (Lsh) (SEQ ID NO: 1) |
| c2c2-3 | *L. wadei* (Lw2) (SEQ ID NO: 2) |
| c2c2-4 | *Listeria seeligeri* (SEQ ID NO: 3) |
| c2c2-5 | 1 Lachnospiraceae bacterium MA2020 (SEQ ID NO: 4) |
| c2c2-6 | 2 Lachnospiraceae bacterium NK4A179 (SEQ ID NO: 5) |
| c2c2-7 | 3 *Clostridium aminophilum* DSM 10710 (SEQ ID NO: 6) |
| c2c2-8 | 5 *Carnobacterium gallinarum* DSM 4847 (SEQ ID NO: 7) |
| c2c2-9 | 6 *Carnobacterium gallinarum* DSM 4847 (SEQ ID NO: 8) |
| c2c2-10 | 7 *Paludibacter propionicigenes* WB4 (SEQ ID NO: 9) |
| c2c2-11 | 9 *Listeria weihenstephanensis* FSL R9-0317 (SEQ ID NO: 10) |
| c2c2-12 | 10 Listeriaceae bacterium FSL M6-0635 = *Listeria newyorkensis* FSL M6-0635 (SEQ ID NO: 11) |
| c2c2-13 | 12 *Leptotrichia wadei* F0279 (SEQ ID NO: 12) |
| c2c2-14 | 15 *Rhodobacter capsulatus* SB 1003 (SEQ ID NO: 13) |
| c2c2-15 | 16 *Rhodobacter capsulatus* R121 (SEQ ID NO: 14) |
| c2c2-16 | 17 *Rhodobacter capsulatus* DE442 (SEQ ID NO: 15) |
| LbuC2c2 | *Leptorichia buccalis* C-1013-b (SEQ ID NO: 309) |
| HheC2c2 | *Herbinix hemicellulosilytica* (SEQ ID NO: 310) |
| EreC2c2 | *Eubacterium rectale* (SEQ ID NO: 311) |

TABLE 2-continued

| | |
|---|---|
| EbaC2C2 | Eubacteriaceae bacterium CHKCI004 (SEQ ID NO: 312) |
| C2c2 NK4A144 | Lachnospiraceae bacterium NK4A144 (SEQ ID NO: 313) |
| C2c2 Chloro_agg | RNA-binding protein S1 *Chloroflexus aggregans* (SEQ ID NO: 314) |
| C2c2 Dem_Aur | *Demequina aurantiaca* (SEQ ID NO: 315) |
| C2c2 Thal_Sp_TSL5 | *Thalassospira* sp. TSL5-1 (SEQ ID NO: 316) |
| C2c2 Pseudo_sp | *Pseudobutyrivibrio* sp. OR37 (SEQ ID NO: 317) |
| C2c2_Buty_sp | *Butyrivibrio* sp. YAB3001 (SEQ ID NO: 318) |
| C2c2_Blautia_sp | *Blautia* sp. Marseille-P2398 (SEQ ID NO: 478) |
| C2c2_Lepto_sp_Marseille | *Leptotrichia* sp. Marseille-P3007 (SEQ ID NO: 320) |
| C2c2_Bacteroides_ihuae | *Bacteroides ihuae* (SEQ ID NO: 321) |
| C2c2_Porph_bacterium | Porphyromonadaceae bacterium KH3CP3RA(SEQ ID NO: 322) |
| C2c2_Listeria_riparia | *Listeria riparia*(SEQ ID NO: 323) |
| C2c2_insolitis_peregrinum | *Insolitispirillum peregrinum*(SEQ ID NO: 324) |

In an embodiment of the invention, there is provided na effector protein which comprises an amino acid sequence having at least 8000 sequence homology to the wild-type sequence of any of *Leptotrichia shahii* C2c2, Lachnospiraceae *bacterium* MA2020 C2c2, Lachnospiraceae *bacterium* NK4A179 C2c2, *Clostridium aminophilum* (DSM 10710) C2c2, *Carnobacterium gallinarum* (DSM 4847) C2c2, *Paludibacter propionicigenes* (WB34) C2c2, *Listeria weihenstephanensis* (FSL R9-0317) C2c2, Listeriaceae *bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2.

In an embodiment of the invention, the effector protein comprises an amino acid sequence having at least 80% sequence homology to a Type VI effector protein consensus sequence including but not limited to a consensus sequence described herein. According to the invention, a consensus sequence can be generated from multiple C2c2 orthologs, which can assist in locating conserved amino acid residues and motifs including, but not limited to, catalytic residues and HEPN motifs in C2c2 orthologs that mediate C2c2 function. One such consensus sequence, generated from the 33 orthologs mentioned above using Geneious alignment is SEQ ID NO: 325.

In another non-limiting example, a sequence alignment tool to assist generation of a consensus sequence and identification of conserved residues is the MUSCLE alignment tool (ebi.ac.uk/Tools/msa/muscle/). For example, using MUSCLE, the following amino acid locations conserved among C2c2 orthologs can be identified in *Leptotrichia wadei* C2c2:K2; K5; V6; E301; L331; I335; N341; G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

An exemplary sequence alignment of HEPN domains showing highly conserved residues is shown in FIG. 50.

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, a N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molcel.2016.12.023, and U.S. Provisional Application No. to be assigned, entitled "Novel Cas13b Orthologues CRISPR Enzymes and System" filed Mar. 15, 2017. In particular embodiments, the Cas13b enzyme is derived from *Bergeyella zoohelcum*. In certain other example embodiments, the effector protein is, or comprises, an amino acid sequence having at least 80% sequence homology to any of the sequences listed in Table 3. (SEQ ID NOS: 479-566 also referenced).

TABLE 3

| | |
|---|---|
| *Bergeyella zoohelcum* | 1 (SEQ ID NO: 326) |
| *Prevotella intermedia* | 2 (SEQ ID NO: 327) |
| *Prevotella buccae* | 3 (SEQ ID NO: 328) |
| *Porphyromonas gingivalis* | 4 (SEQ ID NO: 329) |
| *Bacteroides pyogenes* | 5 (SEQ ID NO: 330) |
| *Alistipes* sp. ZOR0009 | 6 (SEQ ID NO: 331) |
| *Prevotella* sp. MA2016 | 7a (SEQ ID NO: 332) |
| *Prevotella* sp. MA2016 | 7b (SEQ ID NO: 333) |
| *Riemerella anatipestifer* | 8 (SEQ ID NO: 334) |
| *Prevotella aurantiaca* | 9 (SEQ ID NO: 335) |
| *Prevotella saccharolytica* | 10 (SEQ ID NO: 336) |
| HMPREF9712_03108 [*Myroides odoratimimus* CCUG 10230] | 11 (SEQ ID NO: 337) |
| *Prevotella intermedia* | 12 (SEQ ID NO: 338) |
| *Capnocytophaga canimorsus* | 13 (SEQ ID NO: 339) |
| *Porphyromonas gulae* | 14 (SEQ ID NO: 340) |
| *Prevotella* sp. P5-125 | 15 (SEQ ID NO: 341) |
| *Flavobacterium branchiophilum* | 16 (SEQ ID NO: 342) |
| *Myroides odoratimimus* | 17 (SEQ ID NO: 343) |

TABLE 3-continued

| | |
|---|---|
| *Flavobacterium columnare* | 18 (SEQ ID NO: 344) |
| *Porphyromonas gingivalis* | 19 (SEQ ID NO: 345) |
| *Porphyromonas* sp. COT-052 OH4946 | 20 (SEQ ID NO: 346) |
| *Prevotella intermedia* | 21 (SEQ ID NO: 347) |
| PIN17_0200 [*Prevotella intermedia* 17] | AFJ07523 (SEQ ID NO: 348) |
| *Prevotella intermedia* | BAU18625 (SEQ ID NO: 349) |
| HMPREF6485_0083 [*Prevotella buccae* ATCC 33574] | EFU31981 (SEQ ID NO: 350) |
| HMPREF9144_1146 [*Prevotella pallens* ATCC 700821] | EGQ18444 (SEQ ID NO: 351) |
| HMPREF9714_02132 [*Myroides odoratimimus* CCUG 12901] | EHO08761 (SEQ ID NO: 352) |
| HMPREF9711_00870 [*Myroides odoratimimus* CCUG 3837] | EKB06014 (SEQ ID NO: 353) |
| HMPREF9699_02005 [*Bergeyella zoohelcum* ATCC 43767] | EKB54193 (SEQ ID NO: 354) |
| HMPREF9151_01387 [*Prevotella saccharolytica* F0055] | EKY00089 (SEQ ID NO: 355) |
| A343_1752 [*Porphyromonas gingivalis* JCVI SC001] | EOA10535 (SEQ ID NO: 356) |
| HMPREF1981_03090 [*Bacteroides pyogenes* F0041] | ERI81700 (SEQ ID NO: 357) |
| HMPREF1553_02065 [*Porphyromonas gingivalis* F0568] | ERJ65637 (SEQ ID NO: 358) |
| HMPREF1988_01768 [*Porphyromonas gingivalis* F0185] | ERJ81987 (SEQ ID NO: 359) |
| HMPREF1990_01800 [*Porphyromonas gingivalis* W4087] | ERJ87335 (SEQ ID NO: 360) |
| M573_117042 [*Prevotella intermedia* ZT] | KJJ86756 (SEQ ID NO: 361) |
| A2033_10205 [Bacteroidetes bacterium GWA2_31_9] | OFX18020.1 (SEQ ID NO: 362) |
| SAMN05421542_0666 [*Chryseobacterium jejuense*] | SDI27289.1 (SEQ ID NO: 363) |
| SAMN05444360_11366 [*Chryseobacterium carnipullorum*] | SHM52812.1 (SEQ ID NO: 364) |
| SAMN05421786_1011119 [*Chryseobacterium ureilyticum*] | SIS70481.1 (SEQ ID NO: 365) |
| *Prevotella buccae* | WP_004343581 (SEQ ID NO: 366) |
| *Porphyromonas gingivalis* | WP_005873511 (SEQ ID NO: 367) |
| *Porphyromonas gingivalis* | WP_005874195 (SEQ ID NO: 368) |
| *Prevotella pallens* | WP_006044833 (SEQ ID NO: 369) |
| *Myroides odoratimimus* | WP_006261414 (SEQ ID NO: 370) |
| *Myroides odoratimimus* | WP_006265509 (SEQ ID NO: 371) |
| *Prevotella* sp. MSX73 | WP_007412163 (SEQ ID NO: 372) |
| *Porphyromonas gingivalis* | WP_012458414 (SEQ ID NO: 373) |
| *Paludibacter propionicigenes* | WP_013446107 (SEQ ID NO: 374) |
| *Porphyromonas gingivalis* | WP_013816155 (SEQ ID NO: 375) |
| *Flavobacterium columnare* | WP_014165541 (SEQ ID NO: 376) |
| *Psychroflexus torquis* | WP_015024765 (SEQ ID NO: 377) |
| *Riemerella anatipestifer* | WP_015345620 (SEQ ID NO: 378) |
| *Prevotella pleuritidis* | WP_021584635 (SEQ ID NO: 379) |
| *Porphyromonas gingivalis* | WP_021663197 (SEQ ID NO: 380) |
| *Porphyromonas gingivalis* | WP_021665475 (SEQ ID NO: 381) |
| *Porphyromonas gingivalis* | WP_021677657 (SEQ ID NO: 382) |
| *Porphyromonas gingivalis* | WP_021680012 (SEQ ID NO: 383) |
| Porphyromonas gingivalis | WP_023846767 (SEQ ID NO: 384) |
| *Prevotella falsenii* | WP_036884929 (SEQ ID NO: 385) |
| *Prevotella pleuritidis* | WP_036931485 (SEQ ID NO: 386) |
| [*Porphyromonas gingivalis* | WP_039417390 (SEQ ID NO: 387) |
| *Porphyromonas gulae* | WP_039418912 (SEQ ID NO: 388) |
| *Porphyromonas gulae* | WP_039419792 (SEQ ID NO: 389) |
| *Porphyromonas gulae* | WP_039426176 (SEQ ID NO: 390) |
| *Porphyromonas gulae* | WP_039431778 (SEQ ID NO: 391) |
| *Porphyromonas gulae* | WP_039437199 (SEQ ID NO: 392) |
| *Porphyromonas gulae* | WP_039442171 (SEQ ID NO: 393) |
| *Porphyromonas gulae* | WP_039445055 (SEQ ID NO: 394) |
| *Capnocytophaga cynodegmi* | WP_041989581 (SEQ ID NO: 395) |
| *Prevotella* sp. P5-119 | WP_042518169 (SEQ ID NO: 396) |
| *Prevotella* sp. P4-76 | WP_044072147 (SEQ ID NO: 397) |
| *Prevotella* sp. P5-60 | WP_044074780 (SEQ ID NO: 398) |
| *Phaeodactylibacter xiamenensis* | WP_044218239 (SEQ ID NO: 399) |
| *Flavobacterium* sp. 316 | WP_045968377 (SEQ ID NO: 400) |
| *Porphyromonas gulae* | WP_046201018 (SEQ ID NO: 401) |
| WP_047431796 | *Chryseobacterium* sp. YR477 (SEQ ID NO: 402) |
| *Riemerella anatipestifer* | WP_049354263 (SEQ ID NO: 403) |
| *Porphyromonas gingivalis* | WP_052912312 (SEQ ID NO: 404) |
| *Porphyromonas gingivalis* | WP_058019250 (SEQ ID NO: 405) |
| *Flavobacterium columnare* | WP_060381855 (SEQ ID NO: 406) |
| *Porphyromonas gingivalis* | WP_061156470 (SEQ ID NO: 407) |
| *Porphyromonas gingivalis* | WP_061156637 (SEQ ID NO: 408) |
| *Riemerella anatipestifer* | WP_061710138 (SEQ ID NO: 409) |
| *Flavobacterium columnare* | WP_063 744070 (SEQ ID NO: 410) |
| *Riemerella anatipestifer* | WP_064970887 (SEQ ID NO: 411) |
| *Sinomicrobium oceani* | WP_072319476.1 (SEQ ID NO: 412) |
| *Reichenbachiella agariperforans* | WP_073124441.1 (SEQ ID NO: 413) |

In certain example embodiments, the Class 2 type VI CRISPR system is a Cas13c system. In certain example embodiments, the Cas13c orthologue is selected from Table 4 below, which comprises Cas13c orthologues for expression in mammalian cells.

TABLE 4

*Fusobacterium necrophorum* subsp. *funduliforme* ATCC 51357 contig00003 (SEQ ID NO: 616)
*Fusobacterium necrophorum* DJ-2 contig0065, whole genome shotgun sequence (SEQ ID NO: 617)
*Fusobacterium necrophorum* BFTR-1 contig0068 (SEQ ID NO: 618)
*Fusobacterium necrophorum* subsp. *funduliforme* 1_1_36S cont1.14 (SEQ ID NO: 619)
*Fusobacterium perfoetens* ATCC 29250 T364DRAFT_scaffold00009.9_C (SEQ ID NO: 620)
*Fusobacterium ulcerans* ATCC 49185 cont2.38 (SEQ ID NO: 621)
*Anaerosalibacter* sp. ND1 genome assembly *Anaerosalibacter massiliensis* ND1 (SEQ ID NO: 622)

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wildtype orthologue sequences of Cas13c are provided in Table 5 below.

TABLE 5

| Name |
| --- |
| EHO19081 (SEQ ID NO: 567) |
| WP_094899336 (SEQ ID NO: 568) |
| WP_040490876 (SEQ ID NO: 569) |
| WP_047396607 (SEQ ID NO: 570) |
| WP_035935671 (SEQ ID NO: 571) |
| WP_035906563 (SEQ ID NO: 572) |
| WP_042678931 (SEQ ID NO: 573) |
| WP_062627846 (SEQ ID NO: 574) |
| WP_005959231 (SEQ ID NO: 575) |
| WP_027128616 (SEQ ID NO: 576) |
| WP_062624740 (SEQ ID NO: 577) |
| WP_096402050 (SEQ ID NO: 578) |

Guide RNAs

As used herein, the term "crRNA" or "guide RNA" or "single guide RNA," "gRNA" refers to a polynucleotide comprising any polynucleotide sequence having sufficient complementarity with a target nucleic acid sequence to hybridize with the target nucleic acid sequence and to direct sequence-specific binding of an RNA-targeting complex comprising the gRNA and a CRISPR effector protein to the target nucleic acid sequence. In general, a gRNA may be any polynucleotide sequence (i) being able to form a complex with a CRISPR effector protein and (ii) comprising a sequence having sufficient complementarity with a target polynucleotide sequence to hybridize with the target sequence and direct sequence-specific binding of a CRISPR complex to the target sequence. As used herein the term "capable of forming a complex with the CRISPR effector protein" refers to the gRNA having a structure that allows specific binding by the CRISPR effector protein to the gRNA such that a complex is formed that is capable of binding to a target RNA in a sequence specific manner and that can exert a function on said target RNA. Structural components of the gRNA may include direct repeats and a guide sequence (or spacer). The sequence specific binding to the target RNA is mediated by a part of the gRNA, the "guide sequence", being complementary to the target RNA. In embodiments of the invention the term guide RNA, i.e., RNA capable of guiding Cas to a target locus, is used as in foregoing cited documents such as WO 2014/093622 (PCT/US2013/074667). As used herein the term "wherein the guide sequence is capable of hybridizing" refers to a sub-section of the gRNA having sufficient complementarity to the target sequence to hybridize thereto and to mediate binding of a CRISPR complex to the target RNA. In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at novocraft.com), ELAND (Illumina, San Diego, CA), SOAP (available at soap.genomics.org.cn), and Maq (available at maq.sourceforge.net).

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA)

nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e., the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non-coding RNA (ncRNA), long non-coding RNA (lncRNA), and small cytoplasmic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree of secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such as at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g., 1 or more mismatches, such as 1 or 2 mismatches between spacer sequence and target sequence, including the position of the mismatch along the spacer/target. The more central (i.e., not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g., in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e., the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e., adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For, example the systems may be used to distinguish pathogenic strains that differ by a single SNP or detect certain disease specific SNPs such as, but not limited to, disease associated SNPs such as, without limitation, cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g., the synthetic mismatch, i.e., an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end). In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e., one intervening nucleotide).

In certain embodiments, the guide RNA is designed such that the mismatch is located 2 nucleotides downstream of the SNP (i.e., one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

The embodiments described herein comprehend inducing one or more nucleotide modifications in a eukaryotic cell (in vitro, i.e., in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g., within 1, 2, 3, 4, 5, 6, 7, 8, 9, 10, 20, 50, or more base pairs from) the target sequence, but may depend on for instance secondary structure, in particular in the case of RNA targets.

RNA-Based Masking Constructs

As used herein, a "masking construct" refers to a molecule that can be cleaved or otherwise deactivated by an activated CRISPR system effector protein described herein. The term "masking construct" may also be referred to in the alternative as a "detection construct." In certain example embodiments, the masking construct is an RNA-based masking construct. The masking construct prevents the generation or detection of a positive detectable signal. A positive detectable signal may be any signal that can be detected using optical, fluorescent, chemiluminescent, electrochemical or other detection methods known in the art. The masking construct may prevent the generation of a detectable positive signal or mask the presence of a detectable positive signal until the masking construct is removed or otherwise silenced. The term "positive detectable signal" is used to differentiate from other detectable signals that may be detectable in the presence of the masking construct. For example, in certain embodiments a first signal may be detected when the masking agent is present (i.e., a negative detectable signal), which then converts to a second signal (e.g., the positive detectable signal) upon detection of the target molecules and cleavage or deactivation of the masking agent by the activated CRISPR effector protein.

In certain example embodiments, the masking construct may suppress generation of a gene product. The gene product may be encoded by a reporter construct that is added to the sample. The masking construct may be an interfering RNA involved in an RNA interference pathway, such as a shRHN or siRNA. The masking construct may also comprise microRNA (miRNA). While present, the masking construct suppresses expression of the gene product. The gene product may be a fluorescent protein or other RNA transcript or proteins that would otherwise be detectable by a labeled probe or antibody but for the presence of the masking construct. Upon activation of the effector protein the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such a purpose. In certain example embodiments, the one or more reagents are sequestered by RNA aptamers that bind the one or more reagents. The one or more reagents are released when the effector protein is activated upon detection of a target molecule. In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more RNA aptamers to the protein. Upon activation of the effector proteins disclosed herein, the RNA aptamers are cleaved or degraded to the extent they no longer inhibit the protein's ability to generate the detectable signal. In certain example embodiments, the aptamer is a thrombin inhibitor aptamer. In certain example embodiments the thrombin inhibitor aptamer has a sequence of GGGAACAAAGCUGAAGUACUUACCC (SEQ ID NO: 414). When this aptamer is cleaved, thrombin will become active and will cleave a peptide colorimetric or fluorescent substrate. In certain example embodiments, the colorimetric substrate is para-nitroanilide (pNA) covalently linked to the peptide substrate for thrombin. Upon cleavage by thrombin, pNA is released and becomes yellow in color and easily visible to the eye. In certain example embodiments, the fluorescent substrate is 7-amino-4-methylcoumarin a blue fluorophore that can be detected using a fluorescence detector. Inhibitory aptamers may also be used for horseradish peroxidase (HRP), beta-galactosidase, or calf alkaline phosphatase (CAP) within the general principals laid out above.

In certain embodiments, RNAse activity is detected colorimetrically via cleavage of enzyme-inhibiting aptamers. One potential mode of converting RNAse activity into a colorimetric signal is to couple the cleavage of an RNA aptamer with the re-activation of an enzyme that is capable of producing a colorimetric output. In the absence of RNA cleavage, the intact aptamer will bind to the enzyme target and inhibit its activity. The advantage of this readout system is that the enzyme provides an additional amplification step: once liberated from an aptamer via collateral activity (e.g., Cas13a collateral activity), the colorimetric enzyme will continue to produce colorimetric product, leading to a multiplication of signal.

In certain embodiments, an existing aptamer that inhibits an enzyme with a colorimetric readout is used. Several aptamer/enzyme pairs with colorimetric readouts exist, such as thrombin, protein C, neutrophil elastase, and substilisin. These proteases have colorimetric substrates based upon pNA and are commercially available. In certain embodiments, a novel aptamer targeting a common colorimetric enzyme is used. Common and robust enzymes, such as beta-galactosidase, horseradish peroxidase, or calf intestinal alkaline phosphatase, could be targeted by engineered aptamers designed by selection strategies such as SELEX. Such strategies allow for quick selection of aptamers with nanomolar binding efficiencies and could be used for the development of additional enzyme/aptamer pairs for colorimetric readout.

In certain embodiments, RNAse activity is detected colorimetrically via cleavage of RNA-tethered inhibitors. Many common colorimetric enzymes have competitive, reversible inhibitors: for example, beta-galactosidase can be inhibited by galactose. Many of these inhibitors are weak, but their effect can be increased by increases in local concentration. By linking local concentration of inhibitors to RNAse activity, colorimetric enzyme and inhibitor pairs can be engineered into RNAse sensors. The colorimetric RNAse sensor based upon small-molecule inhibitors involves three components: the colorimetric enzyme, the inhibitor, and a bridging RNA that is covalently linked to both the inhibitor and enzyme, tethering the inhibitor to the enzyme. In the uncleaved configuration, the enzyme is inhibited by the increased local concentration of the small molecule; when the RNA is cleaved (e.g., by Cas13a collateral cleavage), the inhibitor will be release and the colorimetric enzyme will be activated.

In certain embodiments, RNAse activity is detected colorimetrically via formation and/or activation of G-quadruplexes. G quadraplexes in DNA can complex with heme (iron (III)-protoporphyrin IX) to form a DNAzyme with peroxidase activity. When supplied with a peroxidase substrate (e.g., ABTS: (2,2'-Azinobis [3-ethylbenzothiazoline-6-sulfonic acid]-diammonium salt)), the G-quadraplex-heme complex in the presence of hydrogen peroxide causes oxidation of the substrate, which then forms a green color in solution. An example G-quadraplex forming DNA sequence is: GGGTAGGGCGGGTTGGGA (SEQ ID NO: 415). By hybridizing an RNA sequence to this DNA aptamer, formation of the G-quadraplex structure will be limited. Upon RNAse collateral activation (e.g., C2c2-complex collateral activation), the RNA staple will be cleaved allowing the G quadraplex to form and heme to bind. This strategy is particularly appealing because color formation is enzymatic, meaning there is additional amplification beyond RNAse activation.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is an RNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is an RNA aptamer. The immobilized reagent may be a protein and the labeled minding partner may be a labeled antibody. Alternatively, the immobilized reagent may be a streptavidin and the labeled binding partner may be labeled biotin. The label on the binding partner used in the above embodiments may be any detectable label known in the art. In addition, other known binding partners may be used in accordance with the overall design described here.

In certain example embodiments, the masking construct may comprise a ribozyme. Ribozymes are RNA molecules having catalytic properties. As ribozymes, both naturally and engineered, comprise or consist of RNA, that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein molecule the reaction generating a negative controls signal or preventing generation of a positive detectable signal is removed, thereby allowing a positive detectable signal to be detected. In one example embodiment, the ribozyme may catalyze a colorimetric reaction causing a solution to appear as a first color. When the ribozyme is deactivated, the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," Biosens Bioelectron. 2014; 16:337-42, and provide an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

Figure 43:
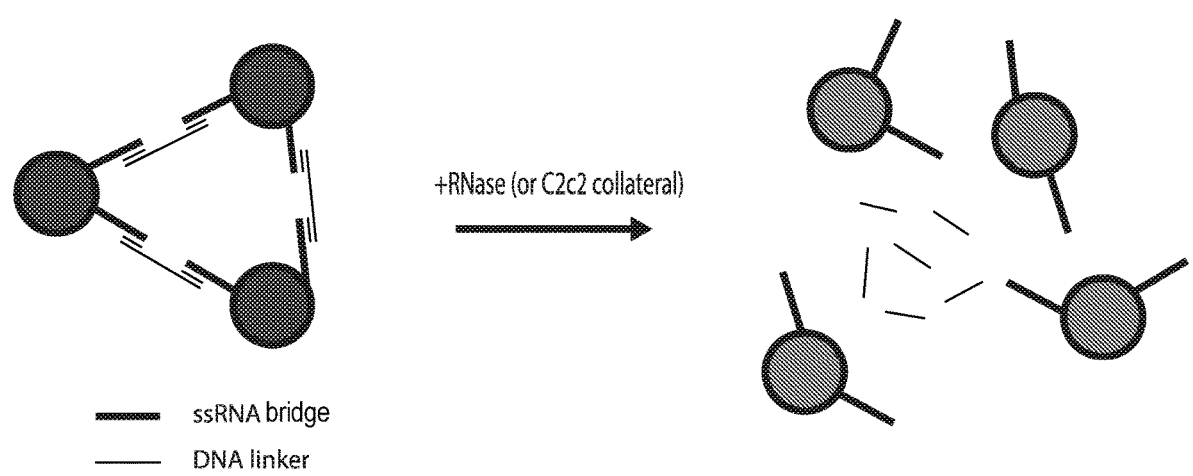
FIG. 43 is a schematic of a gold nanoparticle colorimetric based assay. AuNPs are aggregated using a combination of DNA linkers and an RNA bridge. Upon addition of RNase activity, the ssRNA bridge is cleaved and the AuNPs are released, causing a characteristic color shift toward red.
Figure 44:
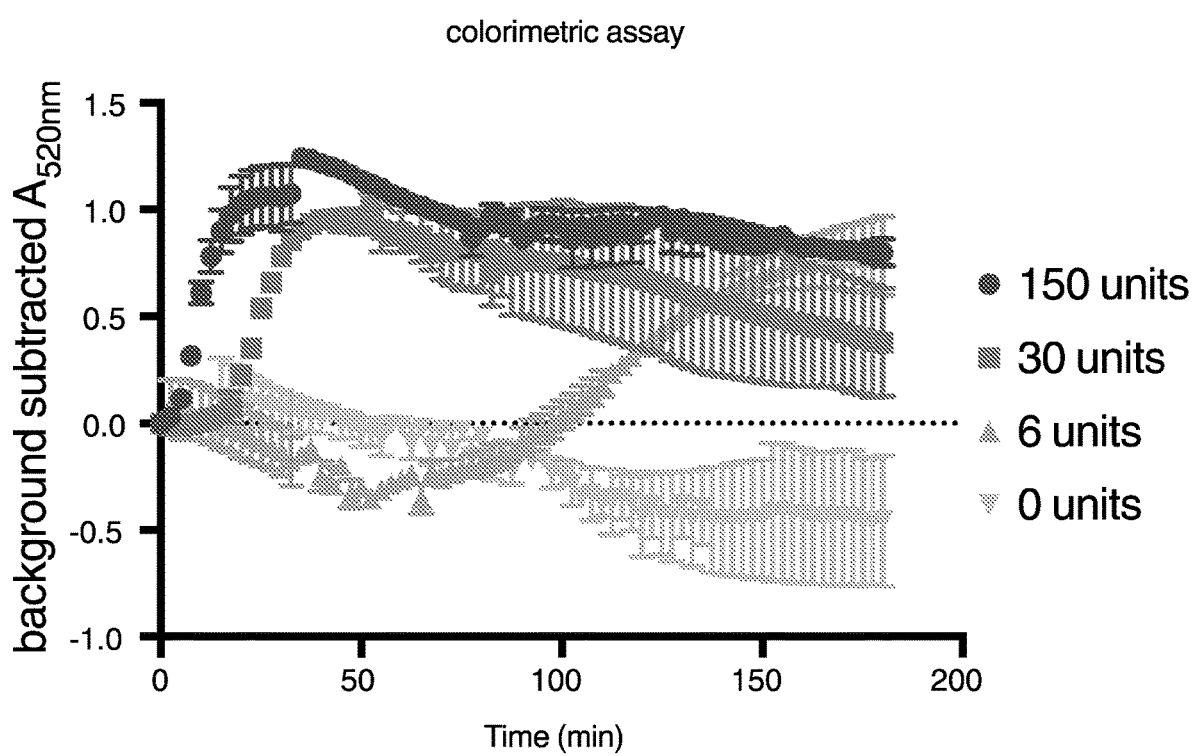
FIG. 44 is a graph showing the ability to detect the shift in color of dispersed nanoparticles at 520 nm. The nanoparticles were based on the example embodiment shown in FIG. 43 and dispersed using addition of RNase A to at varying concentrations.
Figure 45:
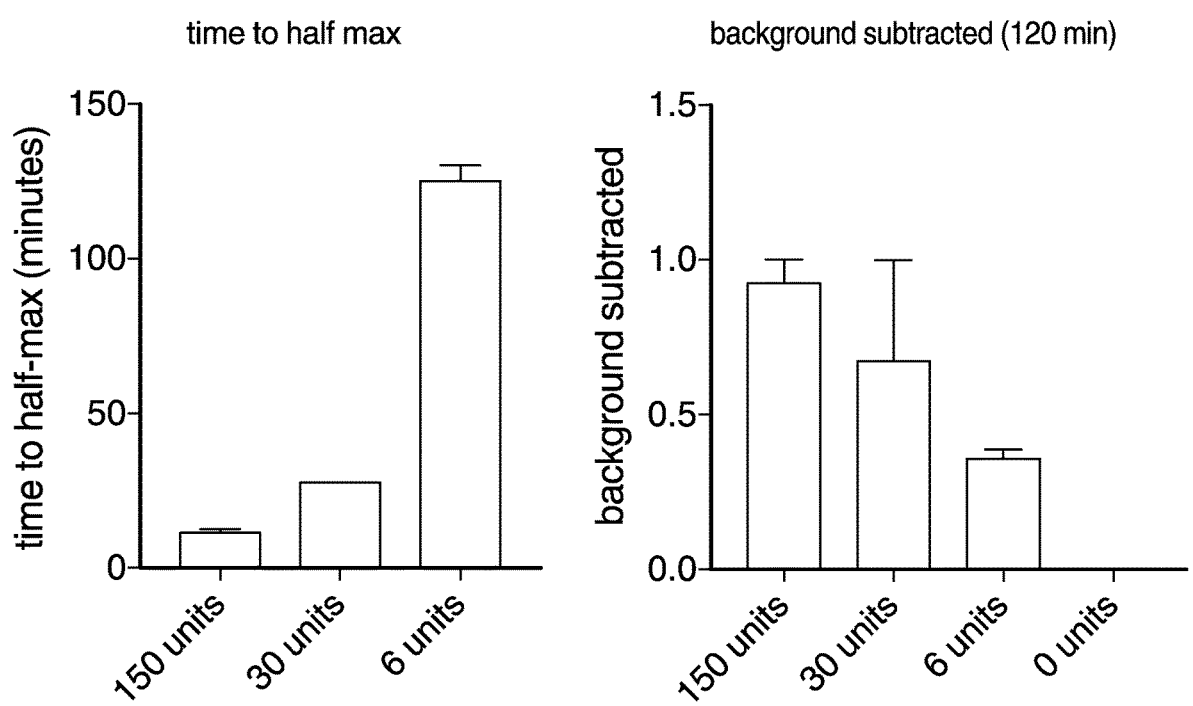
FIG. 45 is a graph showing that the RNase colorimetric test is quantitative.
Figure 46:
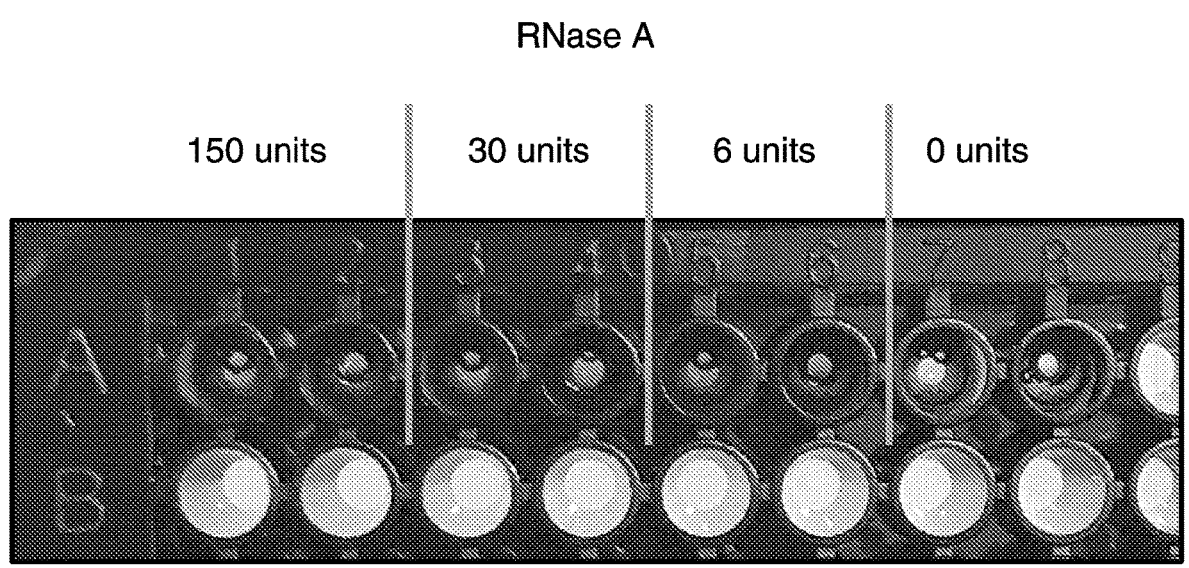
FIG. 46 is a picture of a microwell plate showing that the color shift in the dispersed nanoparticle is visually detectable.
Figure 48:
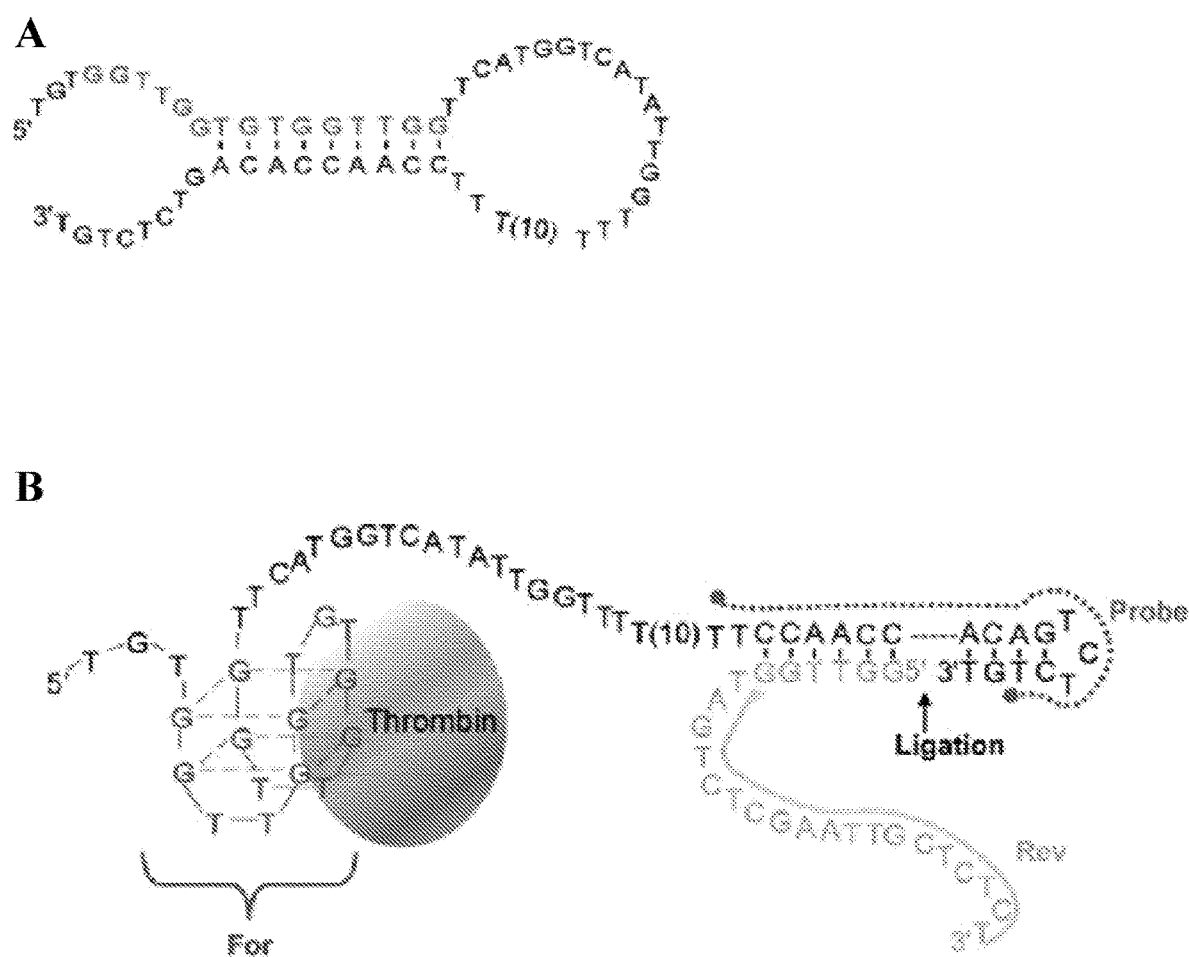
FIG. 48 is a schematic of a conformation switching aptamers in accordance with certain example embodiments for detection of protein or small molecules. The ligated product (B) is used as a complete target for the RNA-targeting effector, which cannot detect the unligated input product. (SEQ ID NOS: 202 and 424).
Figure 49:
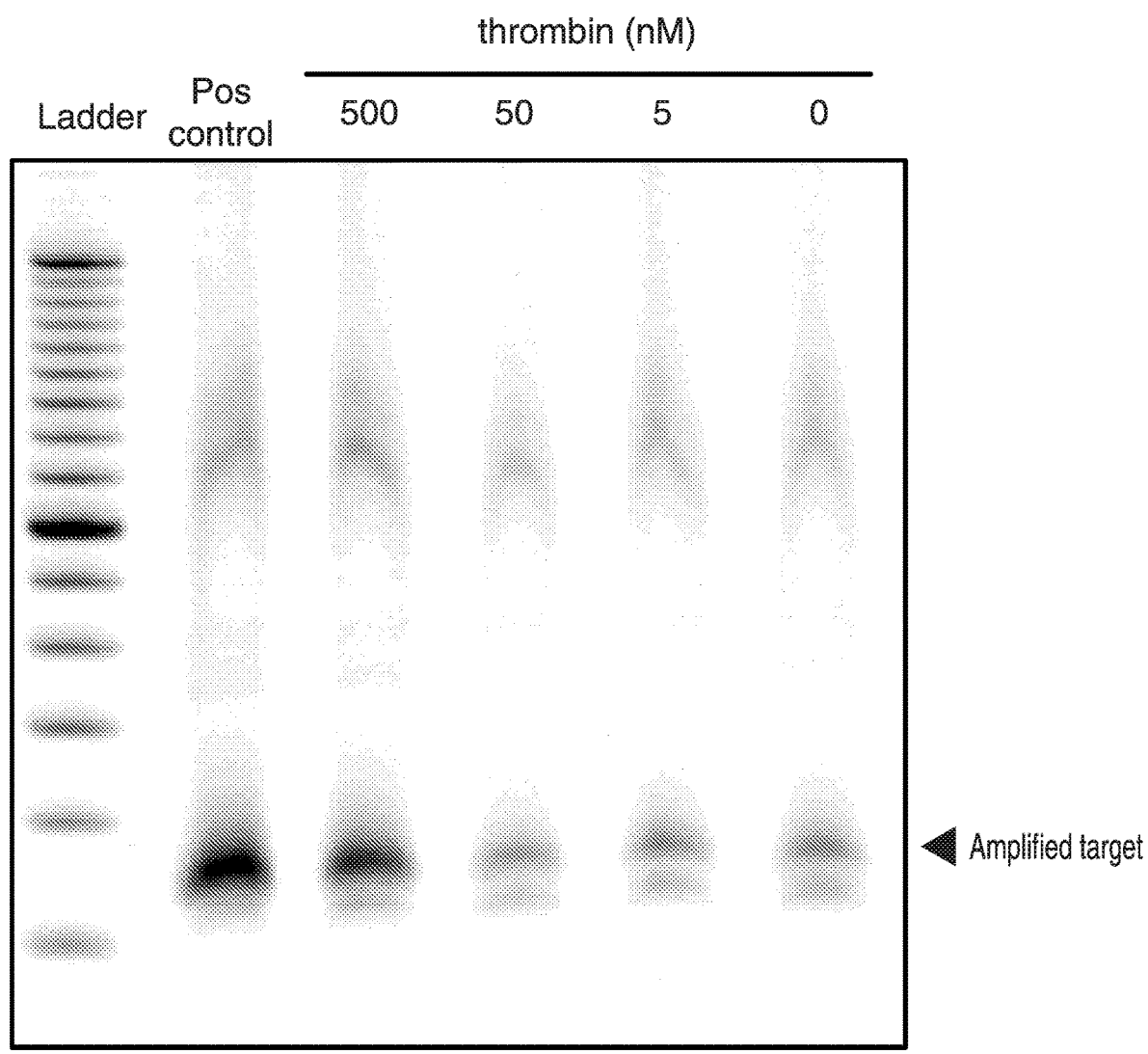
FIG. 49 is an image of a gel showing that aptamer-based ligation can create RPA-detectable substrates. Aptamers were incubated with various levels of thrombin and then ligated with probe. Ligated constructs were used as templates for a 3-minute RPA reaction. 500 nM thrombin has significantly higher levels of amplified target than background.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. See e.g., FIG. 43. At least a portion of the bridge molecule comprises RNA. Upon activation of the effector proteins disclosed herein, the RNA portion of the bridge molecule is cleaved allowing the detection agent to disperse and resulting in the corresponding change in color. See e.g., FIG. 45. In certain example embodiments the bridge molecule is an RNA molecule. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al3+$, $Ru3+$, $Zn2+$, $Fe3+$, $Ni2+$ and $Ca2+$ ions.

When the RNA bridge is cut by the activated CRISPR effector, the beforementioned color shift is observed. In certain example embodiments the particles are colloidal metals. In certain other example embodiments, the colloidal metal is a colloidal gold. In certain example embodiments, the colloidal nanoparticles are 15 nm gold nanoparticles (AuNPs). Due to the unique surface properties of colloidal gold nanoparticles, maximal absorbance is observed at 520 nm when fully dispersed in solution and appear red in color to the naked eye. Upon aggregation of AuNPs, they exhibit a red-shift in maximal absorbance and appear darker in color, eventually precipitating from solution as a dark purple aggregate. In certain example embodiments the nanoparticles are modified to include DNA linkers extending from the surface of the nanoparticle. Individual particles are linked together by single-stranded RNA (ssRNA) bridges that hybridize on each end of the RNA to at least a portion of the DNA linkers. Thus, the nanoparticles will form a web of linked particles and aggregate, appearing as a dark precipitate. Upon activation of the CRISPR effectors disclosed herein, the ssRNA bridge will be cleaved, releasing the AU NPS from the linked mesh and producing a visible red color. Example DNA linkers and RNA bridge sequences are listed below in Table 6. Thiol linkers on the end of the DNA linkers may be used for surface conjugation to the AuNPS. Other forms of conjugation may be used. In certain example embodiments, two populations of AuNPs may be generated, one for each DNA linker. This will help facilitate proper binding of the ssRNA bridge with proper orientation.

In certain example embodiments, a first DNA linker is conjugated by the 3' end while a second DNA linker is conjugated by the 5' end.

TABLE 6

| | |
|---|---|
| C2c2 colorimetric DNA1 | TTATAACTATTCCTAAAAAAAAAAA/ 3ThioMC3-D/(SEQ. ID NO: 183) |
| C2c2 colorimetric DNA2 | /5ThioMC6-D/AAAAAAAAACTCCCCTAA TAACAAT (SEQ. ID NO: 184) |
| C2c2 colorimetric bridge | GGGUAGGAAUAGUUAUAAUUUCCCUUUCCCAU UGUUAUUAGGGAG (SEQ. ID NO: 185) |

In some embodiments, one or more elements of a nucleic acid-targeting system is derived from a particular organism comprising an endogenous CRISPR RNA-targeting system. In certain embodiments, the CRISPR RNA-targeting system is found in *Eubacterium* and Ruminococcus. In certain embodiments, the effector protein comprises targeted and collateral ssRNA cleavage activity. In certain embodiments, the effector protein comprises dual HEPN domains. In certain embodiments, the effector protein lacks a counterpart to the Helical-1 domain of Cas13a. In certain embodiments, the effector protein is smaller than previously characterized class 2 CRISPR effectors, with a median size of 928 aa. This median size is 190 aa (17%) less than that of Cas13c, more than 200 aa (18%) less than that of Cas13b, and more than 300 aa (26%) less than that of Cas13a. In certain embodiments, the effector protein has no requirement for a flanking sequence (e.g., PFS, PAM).

In certain embodiments, the effector protein locus structures include a WYL domain containing accessory protein (so denoted after three amino acids that were conserved in the originally identified group of these domains; see, e.g., WYL domain IPR026881). In certain embodiments, the WYL domain accessory protein comprises at least one helix-turn-helix (HTH) or ribbon-helix-helix (RHH) DNA-binding domain. In certain embodiments, the WYL domain containing accessory protein increases both the targeted and the collateral ssRNA cleavage activity of the RNA-targeting effector protein. In certain embodiments, the WYL domain containing accessory protein comprises an N-terminal RHH domain, as well as a pattern of primarily hydrophobic conserved residues, including an invariant tyrosine-leucine doublet corresponding to the original WYL motif. In certain embodiments, the WYL domain containing accessory protein is WYL1. WYL1 is a single WYL-domain protein associated primarily with Ruminococcus.

In other example embodiments, the Type VI RNA-targeting Cas enzyme is Cas 13d. In certain embodiments, Cas13d is *Eubacterium* siraeum DSM 15702 (EsCas13d) or Ruminococcus sp. N15.MGS-57 (RspCas13d) (see, e.g., Yan et al., Cas13d Is a Compact RNA-Targeting Type VI CRISPR Effector Positively Modulated by a WYL-Domain-Containing Accessory Protein, Molecular Cell (2018), doi.org/10.1016/j.molcel.2018.02.028). RspCas13d and EsCas13d have no flanking sequence requirements (e.g., PFS, PAM).

In certain other example embodiments, the masking construct may comprise an RNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA oligonucleotide is cleaved thereby severing the proximity between the fluorophore and quencher needed to maintain the contact quenching effect. Accordingly, detection of the fluorophore may be used to determine the presence of a target molecule in a sample.

In certain other example embodiments, the masking construct may comprise one or more RNA oligonucleotides to which are attached one or more metal nanoparticles, such as gold nanoparticles. In some embodiments, the masking construct comprises a plurality of metal nanoparticles crosslinked by a plurality of RNA oligonucleotides forming a closed loop. In one embodiment, the masking construct comprises three gold nanoparticles crosslinked by three RNA oligonucleotides forming a closed loop. In some embodiments, the cleavage of the RNA oligonucleotides by the CRISPR effector protein leads to a detectable signal produced by the metal nanoparticles.

In certain other example embodiments, the masking construct may comprise one or more RNA oligonucleotides to which are attached one or more quantum dots. In some embodiments, the cleavage of the RNA oligonucleotides by the CRISPR effector protein leads to a detectable signal produced by the quantum dots.

In one example embodiment, the masking construct may comprise a quantum dot. The quantum dot may have multiple linker molecules attached to the surface. At least a portion of the linker molecule comprises RNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art Upon activation of the effector proteins disclosed herein, the RNA portion of the linker molecule is cleaved thereby eliminating the proximity between the quantum dot and one or more quenchers needed to maintain the quenching effect. In certain example embodiments the quantum dot is streptavidin conjugated. RNA are attached via biotin linkers and recruit quenching molecules with the sequences /5Biosg/UCUCGUACGUUC/3IAbRQSp/(SEQ ID NO: 416) or /5Biosg/UCUCGUACGUUCUCUCGUACGUUC/3IAbRQSp/ (SEQ ID NO: 417), where /5Biosg/is a biotin tag and/3IAbRQSp/is an Iowa black quencher. Upon cleavage, by the activated effectors disclosed herein the quantum dot will fluoresce visibly.

In a similar fashion, fluorescence energy transfer (FRET) may be used to generate a detectable positive signal. FRET is a non-radiative process by which a photon from an energetically excited fluorophore (i.e., "donor fluorophore") raises the energy state of an electron in another molecule (i.e., "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is loss as heat. Thus, in the context of the embodiments disclosed herein, the fluorophore/quencher pair is replaced with a donor fluorophore/acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

In certain example embodiments, the masking construct comprises the use of intercalating dyes which change their absorbance in response to cleavage of long RNAs to short nucleotides. Several such dyes exist. For example, pyronine-Y will complex with RNA and form a complex that has an absorbance at 572 nm. Cleavage of the RNA results in loss of absorbance and a color change. Methylene blue may be used in a similar fashion, with changes in absorbance at 688 nm upon RNA cleavage. Accordingly, in certain example embodiments the masking construct comprises an RNA and intercalating dye complex that changes absorbance upon the cleavage of RNA by the effector proteins disclosed herein.

Amplification

In certain example embodiments, target RNAs and/or DNAs may be amplified prior to activating the CRISPR effector protein. Any suitable RNA or DNA amplification technique may be used. In certain example embodiments, the RNA or DNA amplification is an isothermal amplification. In certain example embodiments, the isothermal amplification may be nucleic-acid sequenced-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

In certain example embodiments, the RNA or DNA amplification is nucleic acid sequence-based amplification is NASBA, which is initiated with reverse transcription of target RNA by a sequence-specific reverse primer to create an RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

In certain other example embodiments, a recombinase polymerase amplification (RPA) reaction may be used to amplify the target nucleic acids. RPA reactions employ recombinases which are capable of pairing sequence-specific primers with homologous sequence in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, an RNA polymerase promoter, such as a T7 promoter, is added to one of the primers. This results in an amplified double-stranded DNA product comprising the target sequence and an RNA polymerase promoter. After, or during, the RPA reaction, an RNA polymerase is added that will produce RNA from the double-stranded DNA templates. The amplified target RNA can then in turn be detected by the CRISPR effector system. In this way target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Accordingly, in certain example embodiments the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride ($MgCl_2$), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [$(NH_4)_2SO_4$], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful or the invention, including Taq polymerase, Q5 polymerase, or the like.

In some embodiments, amplification reagents as described herein may be appropriate for use in hot-start amplification. Hot start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or apatamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reactions conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

Target RNA/DNA Enrichment

In certain example embodiments, target RNA or DNA may first be enriched prior to detection or amplification of the target RNA or DNA. In certain example embodiments, this enrichment may be achieved by binding of the target nucleic acids by a CRISPR effector system.

Current target-specific enrichment protocols require single-stranded nucleic acid prior to hybridization with probes. Among various advantages, the present embodiments can skip this step and enable direct targeting to double-stranded DNA (either partly or completely double-stranded). In addition, the embodiments disclosed herein are enzyme-driven targeting methods that offer faster kinetics and easier workflow allowing for isothermal enrichment. In certain example embodiments enrichment may take place between 20-37° C. In certain example embodiments, a set of guide RNAs to different target nucleic acids are used in a single assay, allowing for detection of multiple targets and/or multiple variants of a single target.

In certain example embodiments, the dead CRISPR effector protein may bind the target nucleic acid in solution and then subsequently be isolated from said solution. For example, the dead CRISPR effector protein bound to the target nucleic acid, may be isolated from the solution using an antibody or other molecule, such as an aptamer, that specifically binds the dead CRISPR effector protein.

In other example embodiments, the dead CRISPR effector protein may bound to a solid substrate. A fixed substrate may refer to any material that is appropriate for or can be modified to be appropriate for the attachment of a polypeptide or a polynucleotide. Possible substrates include, but are not limited to, glass and modified functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, ceramics, resins, silica or silica-based materials including silicon and modified silicon, carbon, metals, inorganic glasses, plastics, optical fiber bundes, and a variety of other polymers. In some embodiments, the solid support comprises a patterned surface suitable for immobilization of molecules in an ordered pattern. In certain embodiments a patterned surface refers to an arrangement of different regions in or on an exposed layer of a solid support. In some embodiments, the solid support comprises an array of wells or depressions in a surface. The composition and geometry of the solid support can vary with its use. In some embodiments, the solids support is a planar structure such as a slide, chip, microchip and/or array. As such, the surface of the substrate can be in the form of a planar layer. In some embodiments, the solid support comprises one or more surfaces of a flowcell. The term "flowcell" as used herein refers to a chamber comprising a solid surface across which one or more fluid reagent can be flowed. Example flowcells and related fluidic systems and detection platforms that can be readily used in the methods of the present disclosure are described, for example, in Bentley et al. Nature 456:53-59 (2008), WO 04/0918497, U.S. Pat. No. 7,057,026; WO 91/06678; WO 07/123744; U.S. Pat. Nos. 7,329,492; 7,211,414; 7,315,019; 7,405,281, and US 2008/0108082. In some embodiments, the solid support or its surface is non-planar, such as the inner or outer surface of a tube or vessel. In some embodiments, the solid support comprises microspheres or beads. "Microspheres," "bead," "particles," are intended to mean within the context of a solid substrate to mean small discrete particles made of various material including, but not limited to, plastics, ceramics, glass, and polystyrene. In certain embodiments, the microspheres are magnetic microspheres or beads. Alternatively, or additionally, the beads may be porous. The bead sizes range from nanometers, e.g., 100 nm, to millimeters, e.g., 1 mm.

A sample containing, or suspected of containing, the target nucleic acids may then be exposed to the substrate to allow binding of the target nucleic acids to the bound dead CRISPR effector protein. Non-target molecules may then be washed away. In certain example embodiments, the target nucleic acids may then be released from the CRISPR effector protein/guide RNA complex for further detection using the methods disclosed herein. In certain example embodiments, the target nucleic acids may first be amplified as described herein.

In certain example embodiments, the CRISPR effector may be labeled with a binding tag. In certain example embodiments the CRISPR effector may be chemically tagged. For example, the CRISPR effector may be chemically biotinylated. In another example embodiment, a fusion may be created by adding additional sequence encoding a fusion to the CRISPR effector. One example of such a fusion is an AviTag™, which employs a highly targeted enzymatic conjugation of a single biotin on a unique 15 amino acid peptide tag. In certain embodiments, the CRISPR effector may be labeled with a capture tag such as, but not limited to, GST, Myc, hemagglutinin (HA), green fluorescent protein (GFP), flag, His tag, TAP tag, and Fc tag. The binding tag, whether a fusion, chemical tag, or capture tag, may be used to either pull down the CRISPR effector system once it has bound a target nucleic acid or to fix the CRISPR effector system on the solid substrate.

In certain example embodiments, the guide RNA may be labeled with a binding tag. In certain example embodiments, the entire guide RNA may be labeled using in vitro transcription (IVT) incorporating one or more biotinylated nucleotides, such as, biotinylated uracil. In some embodiments, biotin can be chemically or enzymatically added to the guide RNA, such as, the addition of one or more biotin groups to the 3' end of the guide RNA. The binding tag may be used to pull down the guide RNA/target nucleic acid complex after binding has occurred, for example, by exposing the guide RNA/target nucleic acid to a streptavidin coated solid substrate.

Accordingly, in certain example embodiments, an engineered or non-naturally-occurring CRISPR effector may be used for enrichment purposes. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of the RNA strand at the target locus of interest. In a preferred embodiment, the one or more mutations may comprise two mutations. In a preferred embodiment the one or more amino acid residues are modified in a C2c2 effector protein, e.g., an engineered or non-naturally-occurring effector protein or C2c2. In particular embodiments, the one or more modified of mutated amino acid residues are one or more of those in C2c2 corresponding to R597, H602, R1278 and H1283 (referenced to Lsh C2c2 amino acids), such as mutations R597A, H602A, R1278A and H1283A, or the corresponding amino acid residues in Lsh C2c2 orthologues.

In particular embodiments, the one or more modified of mutated amino acid residues are one or more of those in C2c2 corresponding to K2, K39, V40, E479, L514, V518, N524, G534, K535, E580, L597, V602, D630, F676, L709, I713, R717 (HEPN), N718, H722 (HEPN), E773, P823, V828, I879, Y880, F884, Y997, L1001, F1009, L1013, Y1093, L1099, L1111, Y1114, L1203, D1222, Y1244, L1250, L1253, K1261, I1334, L1355, L1359, R1362, Y1366, E1371, R1372, D1373, R1509 (HEPN), H1514 (HEPN), Y1543, D1544, K1546, K1548, V1551, I1558, according to C2c2 consensus numbering. In certain embodiments, the one or more modified of mutated amino acid residues are one or more of those in C2c2 corresponding to R717 and R1509. In certain embodiments, the one or more modified of mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having a reduced activity, such as reduced specificity. In certain embodiments, said mutations result in a protein having no catalytic activity (i.e., "dead" C2c2). In an embodiment, said amino acid residues correspond to Lsh C2c2 amino acid residues, or the corresponding amino acid residues of a C2c2 protein from a different species. Devices that can facilitate these steps.

The above enrichment systems may also be used to deplete a sample of certain nucleic acids. For example, guide RNAs may be designed to bind non-target RNAs to remove the non-target RNAs from the sample. In one example embodiment, the guide RNAs may be designed to bind nucleic acids that do carry a particular nucleic acid variation. For example, in a given sample a higher copy number of non-variant nucleic acids may be expected. Accordingly, the embodiments disclosed herein may be used to remove the non-variant nucleic acids from a sample, to increase the efficiency with which the detection CRISPR effector system can detect the target variant sequences in a given sample.

Detection of Proteins

The systems, devices, and methods disclosed herein may be adapted for detection of polypeptides (or other molecules) in addition to detection of nucleic acids, via incorporation of a specifically configured polypeptide detection aptamer. The polypeptide detection aptamers are distinct from the masking construct aptamers discussed above. First, the aptamers are designed to specifically bind to one or more target molecules. In one example embodiment, the target molecule is a target polypeptide. In another example embodiment, the target molecule is a target chemical compounds, such as a target therapeutic molecule. Methods for designing and selecting aptamers with specificity for a given target, such as SELEX, are known in the art. In addition to specificity to a given target, the aptamers are further designed to incorporate an RNA polymerase promoter binding site. In certain example embodiments, the RNA polymerase promoter is a T7 promoter. Prior to binding to a target, the RNA polymerase site is not accessible or otherwise recognizable to an RNA polymerase. However, the aptamer is configured so that upon binding of a target the structure of the aptamer undergoes a conformational change such that the RNA polymerase promoter is exposed. An aptamer sequence downstream of the RNA polymerase promoter acts as a template for generation of a trigger RNA oligonucleotide by an RNA polymerase. Thus, the template portion of the aptamer may further incorporate a barcode or other identifying sequence that identifies a given aptamer and its target. Guide RNAs as described above may then be designed to recognize these specific trigger oligonucleotide sequences. Binding of the guide RNAs to the trigger oligonucleotides activates the CRISPR effector proteins which proceeds to deactivate the masking constructs and generate a positive detectable signal as described previously.

Accordingly, in certain example embodiments, the methods disclosed herein comprise the additional step of distributing a sample or set of sample into a set of individual discrete volumes, each individual discrete volume comprising peptide detection aptamers, a CRISPR effector protein, one or more guide RNAs, a masking construct, and incubating the sample or set of samples under conditions sufficient to allow binding of the peptide detection aptamers to the one or more target molecules, wherein binding of the aptamer to a corresponding target exposed the RNA polymerase promoter binding site resulting in synthesis of a trigger RNA via binding of an RNA polymerase to the RNA polymerase promoter binding site.

In another example embodiment, binding of the aptamer may expose a primer binding site upon binding of the aptamer to a target polypeptide. For example, the aptamer may expose an RPA primer binding site. Thus, the addition or inclusion of the primer will then feed into an amplification reaction, such as the RPA reaction as outlined above.

In certain example embodiments, the aptamer may be a conformation-switching aptamer, which upon binding to the target of interest may change secondary structure and expose new regions of single-stranded DNA. In certain example embodiments, these new-regions of single-stranded DNA may be used as substrates for ligation, extending the aptamers and creating longer ssDNA molecules which can be specifically detected using the embodiments disclosed herein. The aptamer design could be further combined with ternary complexes for detection of low-epitope targets, such as glucose (Yang et a. 2015: pubs.acs.org/doi/abs/10.1021/acs.analchem.5b01634). Example conformation shifting aptamers and corresponding guide RNAs (crRNAs) are shown in Table 7 below.

TABLE 7

| | |
|---|---|
| Thrombin aptamer | (SEQ ID NO: 186) |
| Thrombin ligation probe | (SEQ ID NO: 187) |
| Thrombin RPA forward 1 primer | (SEQ ID NO: 188) |
| Thrombin RPA forward 2 primer | (SEQ ID NO: 189) |
| Thrombin RPA reverse 1 primer | (SEQ ID NO: 190) |
| Thrombin crRNA 1 | (SEQ ID NO: 191) |
| Thrombin crRNA 2 | (SEQ ID NO: 192) |
| Thrombin crRNA 3 | (SEQ ID NO: 193) |
| PTK7 full length amplicon control | (SEQ ID NO: 194) |
| PTK7 aptamer | (SEQ ID NO: 195) |
| PTK7 ligation probe | (SEQ ID NO: 196) |
| PTK7 RPA forward 1 primer | (SEQ ID NO: 197) |
| PTK7 RPA reverse 1 primer | (SEQ ID NO: 198) |
| PTK7 crRNA 1 | (SEQ ID NO: 199) |
| PTK7 crRNA 2 | (SEQ ID NO: 200) |
| PTK7 crRNA 3 | (SEQ ID NO: 201) |

Devices

The systems described herein can be embodied on diagnostic devices. A number of substrates and configurations of devices capable of defining multiple individual discrete volumes within the device may be used. As used herein "individual discrete volume" refers to a discrete space, such as a container, receptacle, or other arbitrary defined volume or space that can be defined by properties that prevent and/or inhibit migration of target molecules, for example a volume or space defined by physical properties such as walls, for example the walls of a well, tube, or a surface of a droplet, which may be impermeable or semipermeable, or as defined by other means such as chemical, diffusion rate limited, electro-magnetic, or light illumination, or any combination thereof that can contain a target molecule and a indexable nucleic acid identifier (for example nucleic acid barcode). By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electro-magnetically" defined volume or space is meant spaces where the electro-magnetic properties of the target molecules or their supports such as charged or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the use of non-walled, or semipermeable discrete volumes is that some reagents, such as buffers, chemical activators, or other agents may be passed through the discrete volume, while other materials, such as target molecules, may be maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain embodiments, the compartment is an aqueous droplet in a water-in-oil emulsion. In specific embodiments, any of the applications, methods, or systems described herein requiring exact or uniform volumes may employ the use of an acoustic liquid dispenser.

In certain example embodiments, the device comprises a flexible material substrate on which a number of spots may be defined. Flexible substrate materials suitable for use in diagnostics and biosensing are known within the art. The flexible substrate materials may be made of plant derived fibers, such as cellulosic fibers, or may be made from flexible polymers such as flexible polyester films and other polymer types. Within each defined spot, reagents of the system described herein are applied to the individual spots. Each spot may contain the same reagents except for a different guide RNA or set of guide RNAs, or where applicable, a different detection aptamer to screen for multiple targets at once. Thus, the systems and devices herein may be able to screen samples from multiple sources (e.g., multiple clinical samples from different individuals) for the presence of the same target, or a limited number of targets, or aliquots of a single sample (or multiple samples from the same source) for the presence of multiple different targets in the sample. In certain example embodiments, the elements of the systems described herein are freeze dried onto the paper or cloth substrate. Example flexible material-based substrates that may be used in certain example devices are disclosed in Pardee et al. *Cell.* 2016, 165(5):1255-66 and Pardee et al. *Cell.* 2014, 159(4):950-54. Suitable flexible material-based substrates for use with biological fluids, including blood are disclosed in International Patent Application Publication No. WO/2013/071301 entitled "Paper based diagnostic test" to Shevkoplyas et al. U.S. Patent Application Publication No. 2011/0111517 entitled "Paper-based microfluidic systems" to Siegel et al. and Shafiee et al. "Paper and Flexible Substrates as Materials for Biosensing Platforms to Detect Multiple Biotargets" Scientific Reports 5:8719 (2015). Further flexible based materials, including those suitable for use in wearable diagnostic devices are disclosed in Wang et al. "Flexible Substrate-Based Devices for Point-of-Care Diagnostics" Cell 34(11):909-21 (2016). Further flexible based materials may include nitrocellulose, polycarbonate, methylethyl cellulose, polyvinylidene fluoride (PVDF), polystyrene, or glass (see e.g., US20120238008). In certain embodiments, discrete volumes are separated by a hydrophobic surface, such as but not limited to wax, photoresist, or solid ink.

In some embodiments, a dosimeter or badge may be provided that serves as a sensor or indicator such that the wearer is notified of exposure to certain microbes or other agents. For example, the systems described herein may be used to detect a particular pathogen. Likewise, aptamer-based embodiments disclosed above may be used to detect both polypeptide as well as other agents, such as chemical agents, to which a specific aptamer may bind. Such a device may be useful for surveillance of soldiers or other military personnel, as well as clinicians, researchers, hospital staff, and the like, in order to provide information relating to exposure to potentially dangerous microbes as quickly as possible, for example for biological or chemical warfare agent detection. In other embodiments, such a surveillance badge may be used for preventing exposure to dangerous microbes or pathogens in immunocompromised patients, burn patients, patients undergoing chemotherapy, children, or elderly individuals.

Samples sources that may be analyzed using the systems and devices described herein include biological samples of a subject or environmental samples. Environmental samples may include surfaces or fluids. The biological samples may include, but are not limited to, saliva, blood, plasma, sera, stool, urine, sputum, mucous, lymph, synovial fluid, spinal fluid, cerebrospinal fluid, a swab from skin or a mucosal membrane, or combination thereof. In an example embodiment, the environmental sample is taken from a solid surface, such as a surface used in the preparation of food or other sensitive compositions and materials.

In other example embodiments, the elements of the systems described herein may be place on a single use substrate, such as swab or cloth that is used to swab a surface or sample fluid. For example, the system could be used to test for the presence of a pathogen on a food by swabbing the surface of a food product, such as a fruit or vegetable. Similarly, the single use substrate may be used to swab other surfaces for detection of certain microbes or agents, such as for use in security screening. Single use substrates may also have applications in forensics, where the CRISPR systems are designed to detect, for example identifying DNA SNPs that may be used to identify a suspect, or certain tissue or cell markers to determine the type of biological matter present in a sample. Likewise, the single use substrate could be used to collect a sample from a patient—such as a saliva sample from the mouth—or a swab of the skin. In other embodiments, a sample or swab may be taken of a meat product on order to detect the presence of absence of contaminants on or within the meat product.

Near-real-time microbial diagnostics are needed for food, clinical, industrial, and other environmental settings (see e.g., Lu T K, Bowers J, and Koeris M S, Trends Biotechnol. 2013 June; 31(6):325-7). In certain embodiments, the present invention is used for rapid detection of foodborne pathogens using guide RNAs specific to a pathogen (e.g., *Campylobacter jejuni, Clostridium perfringens, Salmonella* spp., *Escherichia coli, Bacillus cereus, Listeria monocytogenes, Shigella* spp., *Staphylococcus aureus, Staphylococcal enteritis, Streptococcus, Vibrio cholerae, Vibrio parahaemolyticus, Vibrio vulruficus, Yersinia enterocolitica* and *Yersinia pseudotuberculosis, Brucella* spp., *Corynebacterium ulcerans, Coxiella burnetii,* or *Plesiomonas shigelloides*).

In certain embodiments, the device is or comprises a flow strip. For instance, a lateral flow strip allows for RNAse (e.g., C2c2) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g., anti-FITC) antibodies hybridized at the first line and anti-second molecule (e.g., anti-biotin) antibodies at the second downstream line. As the SHERLOCK reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g., color). As more reporter is cleaved, more signal will accumulate at the second capture line and less signal will appear at the first line. In certain aspects, the invention relates to the use of a follow strip as described herein for detecting nucleic acids or polypeptides. In certain aspects, the invention relates to a method for detecting nucleic acids or polypeptides with a flow strip as defined herein, e.g., (lateral) flow tests or (lateral) flow immunochromatographic assays.

In certain example embodiments, the device is a microfluidic device that generates and/or merges different droplets (i.e., individual discrete volumes). For example, a first set of droplets may be formed containing samples to be screened and a second set of droplets formed containing the elements of the systems described herein. The first and second set of droplets are then merged, and then diagnostic methods as described herein are carried out on the merged droplet set. Microfluidic devices disclosed herein may be silicone-based chips and may be fabricated using a variety of techniques, including, but not limited to, hot embossing, molding of elastomers, injection molding, LIGA, soft lithography, silicon fabrication and related thin film processing techniques. Suitable materials for fabricating the microfluidic devices include, but are not limited to, cyclic olefin copolymer (COC), polycarbonate, poly(dimethylsiloxane) (PDMS), and poly(methylacrylate) (PMMA). In one embodiment, soft lithography in PDMS may be used to prepare the microfluidic devices. For example, a mold may be made using photolithogrophy which defines the location of flow channels, valves, and filters within a substrate. The substrate material is poured into a mold and allowed to set to create a stamp. The stamp is then sealed to a solid support, such as but not limited to, glass. Due to the hydrophobic nature of some polymers, such as PDMS, which absorbs some proteins and may inhibit certain biological processes, a passivating agent may be necessary (Schoffner et al. *Nucleic Acids Research*, 1996, 24:375-379). Suitable passivating agents are known in the art and include, but are not limited to, silanes, parylene, n-Dodecyl-b-D-matoside (DDM), pluronic, Tween-20, other similar surfactants, polyethylene glycol (PEG), albumin, collagen, and other similar proteins and peptides.

In certain example embodiments, the system and/or device may be adapted for conversion to a flow-cytometry readout in or allow to all of sensitive and quantitative measurements of millions of cells in a single experiment and improve upon existing flow-based methods, such as the PrimeFlow assay. In certain example embodiments, cells may be cast in droplets containing unpolymerized gel monomer, which can then be cast into single-cell droplets suitable for analysis by flow cytometry. A detection construct comprising a fluorescent detectable label may be cast into the droplet comprising unpolymerized gel monomer. Upon polymerization of the gel monomer to form a bead within a droplet. Because gel polymerization is through free-radical formation, the fluorescent reporter becomes covalently bound to the gel. The detection construct may be further modified to comprise a linker, such as an amine. A quencher may be added post-gel formation and will bind via the linker to the reporter construct. Thus, the quencher is not bound to the gel and is free to diffuse away when the reporter is cleaved by the CRISPR effector protein. Amplification of signal in droplet may be achieved by coupling the detection construct of hybridization chain reaction (HCR initiators) amplification. DNA/RNA hybrid hairpins may be incorporated into the gel which may comprise a hairpin loop that has an RNase sensitive domain. By protecting a strand displacement toehold within a hairpin loop that has an RNase sensitive domain, HCR initiators may be selectively deprotected following cleavage of the hairpin loop by the CRISPR effector protin. Following deprotection of HCR initiators via toehold mediated strand displacement, fluorescent HCR monomers may be washed into the gel to enable signal amplification where the initiators are deprotected.

An example of microfluidic device that may be used in the context of the invention is described in Hou et al. "Direct detection and drug-resistance profiling of bacteremias using inertial microfluidics" Lap Chip. 15(10):2297-2307 (2016).

In systems described herein, may further be incorporated into wearable medical devices that assess biological samples, such as biological fluids, of a subject outside the clinic setting and report the outcome of the assay remotely to a central server accessible by a medical care professional. The device may include the ability to self-sample blood, such as the devices disclosed in U.S. Patent Application Publication No. 2015/0342509 entitled "Needle-free Blood Draw to Peeters et al., U.S. Patent Application Publication No. 2015/0065821 entitled "Nanoparticle Phoresis" to Andrew Conrad.

In certain example embodiments, the device may comprise individual wells, such as microplate wells. The size of the microplate wells may be the size of standard 6, 24, 96, 384, 1536, 3456, or 9600 sized wells. In certain example embodiments, the elements of the systems described herein may be freeze dried and applied to the surface of the well prior to distribution and use.

The devices disclosed herein may further comprise inlet and outlet ports, or openings, which in turn may be connected to valves, tubes, channels, chambers, and syringes and/or pumps for the introduction and extraction of fluids into and from the device. The devices may be connected to fluid flow actuators that allow directional movement of fluids within the microfluidic device. Example actuators include, but are not limited to, syringe pumps, mechanically actuated recirculating pumps, electroosmotic pumps, bulbs, bellows, diaphragms, or bubbles intended to force movement of fluids. In certain example embodiments, the devices are connected to controllers with programmable valves that work together to move fluids through the device. In certain example embodiments, the devices are connected to the controllers discussed in further detail below. The devices may be connected to flow actuators, controllers, and sample loading devices by tubing that terminates in metal pins for insertion into inlet ports on the device.

As shown herein, the elements of the system are stable when freeze dried, therefore embodiments that do not require a supporting device are also contemplated, i.e., the system may be applied to any surface or fluid that will support the reactions disclosed herein and allow for detection of a positive detectable signal from that surface or solution. In addition to freeze-drying, the systems may also be stably stored and utilized in a pelletized form. Polymers useful in forming suitable pelletized forms are known in the art.

In certain embodiments, the CRISPR effector protein is bound to each discrete volume in the device. Each discrete volume may comprise a different guide RNA specific for a different target molecule. In certain embodiments, a sample is exposed to a solid substrate comprising more than one discrete volume each comprising a guide RNA specific for a target molecule. Not being bound by a theory, each guide RNA will capture its target molecule from the sample and the sample does not need to be divided into separate assays. Thus, a valuable sample may be preserved. The effector protein may be a fusion protein comprising an affinity tag. Affinity tags are well known in the art (e.g., HA tag, Myc tag, Flag tag, His tag, biotin). The effector protein may be linked to a biotin molecule and the discrete volumes may comprise streptavidin. In other embodiments, the CRISPR effector protein is bound by an antibody specific for the effector protein. Methods of binding a CRISPR enzyme has been described previously (see, e.g., US20140356867A1).

The devices disclosed herein may also include elements of point of care (POC) devices known in the art for analyzing samples by other methods. See, for example St John and Price, "Existing and Emerging Technologies for Point-of-Care Testing" (Clin Biochem Rev. 2014 August; 35(3): 155-167).

The present invention may be used with a wireless lab-on-chip (LOC) diagnostic sensor system (see e.g., U.S. Pat. No. 9,470,699 "Diagnostic radio frequency identification sensors and applications thereof"). In certain embodiments, the present invention is performed in a LOC controlled by a wireless device (e.g., a cell phone, a personal digital assistant (PDA), a tablet) and results are reported to said device.

Radio frequency identification (RFID) tag systems include an RFID tag that transmits data for reception by an RFID reader (also referred to as an interrogator). In a typical RFID system, individual objects (e.g., store merchandise) are equipped with a relatively small tag that contains a transponder. The transponder has a memory chip that is given a unique electronic product code. The RFID reader emits a signal activating the transponder within the tag through the use of a communication protocol. Accordingly, the RFID reader is capable of reading and writing data to the tag. Additionally, the RFID tag reader processes the data according to the RFID tag system application. Currently, there are passive and active type RFID tags. The passive-type RFID tag does not contain an internal power source but is powered by radio frequency signals received from the RFID reader. Alternatively, the active-type RFID tag contains an internal power source that enables the active-type RFID tag to possess greater transmission ranges and memory capacity. The use of a passive versus an active tag is dependent upon the particular application.

Lab-on-the chip technology is well described in the scientific literature and consists of multiple microfluidic channels, input or chemical wells. Reactions in wells can be measured using radio frequency identification (RFID) tag technology since conductive leads from RFID electronic chip can be linked directly to each of the test wells. An antenna can be printed or mounted in another layer of the electronic chip or directly on the back of the device. Furthermore, the leads, the antenna and the electronic chip can be embedded into the LOC chip, thereby preventing shorting of the electrodes or electronics. Since LOC allows complex sample separation and analyses, this technology allows LOC tests to be done independently of a complex or expensive reader. Rather a simple wireless device such as a cell phone or a PDA can be used. In one embodiment, the wireless device also controls the separation and control of the microfluidics channels for more complex LOC analyses. In one embodiment, a LED and other electronic measuring or sensing devices are included in the LOC-RFID chip. Not being bound by a theory, this technology is disposable and allows complex tests that require separation and mixing to be performed outside of a laboratory.

In preferred embodiments, the LOC may be a microfluidic device. The LOC may be a passive chip, wherein the chip is powered and controlled through a wireless device. In certain embodiments, the LOC includes a microfluidic channel for holding reagents and a channel for introducing a sample. In certain embodiments, a signal from the wireless device delivers power to the LOC and activates mixing of the sample and assay reagents. Specifically, in the case of the present invention, the system may include a masking agent, CRISPR effector protein, and guide RNAs specific for a target molecule. Upon activation of the LOC, the microfluidic device may mix the sample and assay reagents. Upon mixing, a sensor detects a signal and transmits the results to the wireless device. In certain embodiments, the unmasking agent is a conductive RNA molecule. The conductive RNA molecule may be attached to the conductive material. Conductive molecules can be conductive nanoparticles, conductive proteins, metal particles that are attached to the protein or latex or other beads that are conductive. In certain embodiments, if DNA or RNA is used then the conductive molecules can be attached directly to the matching DNA or RNA strands. The release of the conductive molecules may be detected across a sensor. The assay may be a one step process.

Since the electrical conductivity of the surface area can be measured precisely quantitative results are possible on the disposable wireless RFID electro-assays. Furthermore, the test area can be very small allowing for more tests to be done in a given area and therefore resulting in cost savings. In certain embodiments, separate sensors each associated with a different CRISPR effector protein and guide RNA immobilized to a sensor are used to detect multiple target molecules. Not being bound by a theory, activation of different sensors may be distinguished by the wireless device.

In addition to the conductive methods described herein, other methods may be used that rely on RFID or Bluetooth as the basic low-cost communication and power platform for a disposable RFID assay. For example, optical means may be used to assess the presence and level of a given target molecule. In certain embodiments, an optical sensor detects unmasking of a fluorescent masking agent.

In certain embodiments, the device of the present invention may include handheld portable devices for diagnostic reading of an assay (see e.g., Vashist et al., Commercial Smartphone-Based Devices and Smart Applications for Personalized Healthcare Monitoring and Management, Diagnostics 2014, 4(3), 104-128; mReader from Mobile Assay; and Holomic Rapid Diagnostic Test Reader).

As noted herein, certain embodiments allow detection via colorimetric change which has certain attendant benefits when embodiments are utilized in POC situations and or in resource poor environments where access to more complex detection equipment to readout the signal may be limited. However, portable embodiments disclosed herein may also be coupled with hand-held spectrophotometers that enable detection of signals outside the visible range. An example of a hand-held spectrophotometer device that may be used in combination with the present invention is described in Das et al. "Ultra-portable, wireless smartphone spectrophotometer for rapid, non-destructive testing of fruit ripeness." Nature Scientific Reports. 2016, 6:32504, DOI: 10.1038/srep32504. Finally, in certain embodiments utilizing quantum dot-based masking constructs, use of a hand-held UV light, or other suitable device, may be successfully used to detect a signal owing to the near complete quantum yield provided by quantum dots.

Example Methods and Assays

The low cost and adaptability of the assay platform lends itself to a number of applications including (i) general RNA/DNA/protein quantitation, (ii) rapid, multiplexed RNA/DNA and protein expression detection, and (iii) sensitive detection of target nucleic acids, peptides, and proteins in both clinical and environmental samples. Additionally, the systems disclosed herein may be adapted for detection of transcripts within biological settings, such as cells. Given the highly specific nature of the CRISPR effectors described herein, it may be possible to track allelic specific expression of transcripts or disease-associated mutations in live cells.

In certain example embodiments, a single guide RNA specific to a single target is placed in separate volumes. Each volume may then receive a different sample or aliquot of the same sample. In certain example embodiments, multiple guide RNA each to separate target may be placed in a single well such that multiple targets may be screened in a different well. In order to detect multiple guide RNAs in a single volume, in certain example embodiments, multiple effector proteins with different specificities may be used. For example, different orthologs with different sequence specificities may be used. For example, one orthologue may preferentially cut A, while others preferentially cut C, U, or T. Accordingly, guide RNAs that are all, or comprise a substantial portion, of a single nucleotide may be generated, each with a different fluorophore. In this way, up to four different targets may be screened in a single individual discrete volume.

As demonstrated herein, the CRISPR effector systems are capable of detecting down to attomolar concentrations of target molecules. See e.g., FIGS. 13, 14, 19, 22 and examples described below. Due to the sensitivity of said systems, a number of applications that require from the rapid and sensitive detection may benefit from the embodiments disclosed herein and are contemplated to be within the scope of the invention. Example assays and applications are described in further detail below.

Microbial Applications

In certain example embodiments, the systems, devices, and methods, disclosed herein are directed to detecting the presence of one or more microbial agents in a sample, such as a biological sample obtained from a subject. In certain example embodiments, the microbe may be a *bacterium*, a fungus, a yeast, a protozoa, a parasite, or a virus. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g., bacterial resistance), monitoring of disease progression and/or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used guide therapeutic regimens, such as selection of the appropriate antibiotic or antiviral. The embodiments disclosed herein may also be used to screen environmental samples (air, water, surfaces, food etc.) for the presence of microbial contamination.

Disclosed is a method to identify microbial species, such as bacterial, viral, fungal, yeast, or parasitic species, or the like. Particular embodiments disclosed herein describe methods and systems that will identify and distinguish microbial species within a single sample, or across multiple samples, allowing for recognition of many different microbes. The present methods allow the detection of pathogens and distinguishing between two or more species of one or more organisms, e.g., bacteria, viruses, yeast, protozoa, and fungi or a combination thereof, in a biological or environmental sample, by detecting the presence of a target nucleic acid sequence in the sample. A positive signal obtained from the sample indicates the presence of the microbe. Multiple microbes can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once. In some embodiments, simultaneous detection of multiple microbes may be performed using a set of probes that can identify one or more microbial species.

Multiplex analysis of samples enables large-scale detection of samples, reducing the time and cost of analyses. However, multiplex analyses are often limited by the availability of a biological sample. In accordance with the invention, however, alternatives to multiplex analysis may be performed such that multiple effector proteins can be added to a single sample and each masking construct may be combined with a separate quencher dye. In this case, positive signals may be obtained from each quencher dye separately for multiple detection in a single sample.

Disclosed herein are methods for distinguishing between two or more species of one or more organisms in a sample. The methods are also amenable to detecting one or more species of one or more organisms in a sample.

Microbe Detection

In some embodiments, a method for detecting microbes in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or RNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. If DNA method may further comprise the use of DNA primers that introduce an RNA polymerase promoter as described herein. If the target is a protein, then the method will utilize aptamers and steps specific to protein detection described herein.

Detection of Single Nucleotide Variants

In some embodiments, one or more identified target sequences may be detected using guide RNAs that are specific for and bind to the target sequence as described herein. The systems and methods of the present invention can distinguish even between single nucleotide polymorphisms present among different microbial species and therefore, use of multiple guide RNAs in accordance with the invention may further expand on or improve the number of target sequences that may be used to distinguish between species. For example, in some embodiments, the one or more guide RNAs may distinguish between microbes at the species, genus, family, order, class, phylum, kingdom, or phenotype, or a combination thereof.

Detection Based on rRNA Sequences

In certain example embodiments, the devices, systems, and methods disclosed herein may be used to distinguish multiple microbial species in a sample. In certain example embodiments, identification may be based on ribosomal RNA sequences, including the 16S, 23S, and 5S subunits. Methods for identifying relevant rRNA sequences are disclosed in U.S. Patent Application Publication No. 2017/0029872. In certain example embodiments, a set of guide RNA may be designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that uniquely variable across species or a subset of species such as the RecA gene family, RNA polymerase R subunit, may be used as well. Other suitable phylogenetic markers, and methods for identifying the same, are discussed for example in Wu et al. arXiv:1307.8690 [q-bio.GN].

In certain example embodiments, a method or diagnostic is designed to screen microbes across multiple phylogenetic and/or phenotypic levels at the same time. For example, the method or diagnostic may comprise the use of multiple CRISPR systems with different guide RNAs. A first set of guide RNAs may distinguish, for example, between mycobacteria, gram positive, and gram negative bacteria. These general classes can be even further subdivided. For example, guide RNAs could be designed and used in the method or diagnostic that distinguish enteric and non-enteric within gram negative bacteria. A second set of guide RNA can be designed to distinguish microbes at the genus or species level. Thus, a matrix may be produced identifying all mycobacteria, gram positive, gram negative (further divided into enteric and non-enteric) with each genus of species of bacteria identified in a given sample that fall within one of those classes. The foregoing is for example purposes only. Other means for classifying other microbe types are also contemplated and would follow the general structure described above.

Screening for Drug Resistance

In certain example embodiments, the devices, systems and methods disclosed herein may be used to screen for microbial genes of interest, for example antibiotic and/or antiviral resistance genes. Guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regime. In certain example embodiments, the antibiotic resistance genes are carbapenemases including KPC, NDM1, CTX-M15, OXA-48. Other antibiotic resistance genes are known and may be found for example in the Comprehensive Antibiotic Resistance Database (Jia et al. "CARD 2017: expansion and model-centric curation of the Comprehensive Antibiotic Resistance Database." Nucleic Acids Research, 45, D566-573).

Ribavirin is an effective antiviral that hits a number of RNA viruses. Several clinically important viruses have evolved ribavirin resistance including Foot and Mouth Disease Virus doi:10.1128/JVI.03594-13; polio virus (Pfeifer and Kirkegaard. PNAS, 100(12):7289-7294, 2003); and hepatitis C virus (Pfeiffer and Kirkegaard, J. Virol. 79(4): 2346-2355, 2005). A number of other persistent RNA viruses, such as hepatitis and HIV, have evolved resistance to existing antiviral drugs: hepatitis B virus (lamivudine, tenofovir, entecavir) doi:10/1002/hep22900; hepatitis C virus (telaprevir, BILN2061, ITMN-191, SCh6, boceprevir, AG-021541, ACH-806) doi:10.1002/hep.22549; and HIV (many drug resistance mutations) hivb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi:10.1073/pnas.1019304108), and increased infectivity of Ebola (Diehl et al. Cell. 2016, 167(4):1088-1098.

As described herein elsewhere, closely related microbial species (e.g., having only a single nucleotide difference in a given target sequence) may be distinguished by introduction of a synthetic mismatch in the gRNA.

Set Cover Approaches

In particular embodiments, a set of guide RNAs is designed that can identify, for example, all microbial species within a defined set of microbes. In certain example embodiments, the methods for generating guide RNAs as described herein may be compared to methods disclosed in WO 2017/040316, incorporated herein by reference. As described in WO 2017040316, a set cover solution may identify the minimal number of target sequences probes or guide RNAs needed to cover an entire target sequence or set of target sequences, e.g., a set of genomic sequences. Set cover approaches have been used previously to identify primers and/or microarray probes, typically in the 20 to 50 base pair range. See, e.g., Pearson et al., cs.virginia.edu/~robins/papers/primers_dam11_final.pdf., Jabado et al. Nucleic Acids Res. 2006 34(22):6605-11, Jabado et al. Nucleic Acids Res. 2008, 36(1):e3 doi10.1093/nar/gkm1106, Duitama et al. Nucleic Acids Res. 2009, 37(8): 2483-2492, Phillippy et al. BMC Bioinformatics. 2009, 10:293 doi:10.1186/1471-2105-10-293. However, such approaches generally involved treating each primer/probe as k-mers and searching for exact matches or allowing for inexact matches using suffix arrays. In addition, the methods generally take a binary approach to detecting hybridization by selecting primers or probes such that each input sequence only needs to be bound by one primer or probe and the position of this binding along the sequence is irrelevant. Alternative methods may divide a target genome into predefined windows and effectively treat each window as a separate input sequence under the binary approach—i.e., they determine whether a given probe or guide RNA binds within each window and require that all of the windows be bound by the start of some probe or guide RNA. Effectively, these approaches treat each element of the "universe" in the set cover problem as being either an entire input sequence or a pre-defined window of an input sequence, and each element is considered "covered" if the start of a probe or guide RNA binds within the element. These approaches limit the fluidity to which different probe or guide RNA designs are allowed to cover a given target sequence.

In contrast, the embodiments disclosed herein are directed to detecting longer probe or guide RNA lengths, for example, in the range of 70 bp to 200 bp that are suitable for hybrid selection sequencing. In addition, the methods disclosed WO 2017/040316 herein may be applied to take a pan-target sequence approach capable of defining a probe or guide RNA sets that can identify and facilitate the detection sequencing of all species and/or strains sequences in a large and/or variable target sequence set. For example, the methods disclosed herein may be used to identify all variants of a given virus, or multiple different viruses in a single assay. Further, the method disclosed herein treat each element of the "universe" in the set cover problem as being a nucleotide of a target sequence, and each element is considered "covered" as long as a probe or guide RNA binds to some segment of a target genome that includes the element. The type of set cover methods may be used instead of the binary approach of previous methods. The methods disclosed herein better model how a probe or guide RNA may hybridize to a target sequence. Rather than only asking if a given guide RNA sequence does or does not bind to a given window, such approaches may be used to detect a hybridization pattern—i.e., where a given probe or guide RNA binds to a target sequence or target sequences—and then determines from those hybridization patterns the minimum number of probes or guide RNAs needed to cover the set of target sequences to a degree sufficient to enable both enrichment from a sample and sequencing of any and all target sequences. These hybridization patterns may be determined by defining certain parameters that minimize a loss function, thereby enabling identification of minimal probe or guide RNA sets in a way that allows parameters to vary for each species, e.g., to reflect the diversity of each species, as well as in a computationally efficient manner that cannot be achieved using a straightforward application of a set cover solution, such as those previously applied in the probe or guide RNA design context.

The ability to detect multiple transcript abundances may allow for the generation of unique microbial signatures indicative of a particular phenotype. Various machine learning techniques may be used to derive the gene signatures. Accordingly, the guide RNAs of the CRISPR systems may be used to identify and/or quantitate relative levels of biomarkers defined by the gene signature in order to detect certain phenotypes. In certain example embodiments, the gene signature indicates susceptibility to an antibiotic, resistance to an antibiotic, or a combination thereof.

In one aspect of the invention, a method comprises detecting one or more pathogens. In this manner, differentiation between infection of a subject by individual microbes may be obtained. In some embodiments, such differentiation may enable detection or diagnosis by a clinician of specific diseases, for example, different variants of a disease. Preferably the pathogen sequence is a genome of the pathogen or a fragment thereof. The method further may comprise determining the evolution of the pathogen. Determining the evolution of the pathogen may comprise identification of pathogen mutations, e.g., nucleotide deletion, nucleotide insertion, nucleotide substitution. Amongst the latter, there are non-synonymous, synonymous, and noncoding substitutions. Mutations are more frequently non-synonymous during an outbreak. The method may further comprise determining the substitution rate between two pathogen sequences analyzed as described above. Whether the mutations are deleterious or even adaptive would require functional analysis, however, the rate of non-synonymous mutations suggests that continued progression of this epidemic could afford an opportunity for pathogen adaptation, underscoring the need for rapid containment. Thus, the method may further comprise assessing the risk of viral adaptation, wherein the number non-synonymous mutations is determined. (Gire, et al., Science 345, 1369, 2014).

Monitoring Microbe Outbreaks

In some embodiments, a CRISPR system or methods of use thereof as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g., human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e., at the beginning of the pathogen outbreak. Determining the pattern of the pathogen transmission at the beginning of the outbreak increases likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intra-host and interhost variation provide important insight about transmission and epidemiology (Gire, et al., 2014).

Detection of shared intra-host variations between the subjects that show temporal patterns is an indication of transmission links between subject (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., Cell 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise, superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence. (Park, et al., 2015).

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e., in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of $8\times10-4$ per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leon might stem from the introduction of two genetically distinct viruses from Guinea around the same time (Gire, et al., 2014).

It has been also possible to determine how the Lassa virus spread out from its origin point, in particular thanks to human-to-human transmission and even retrace the history of this spread 400 years back (Andersen, et al., *Cell* 162(4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may use any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip selected probes divided into groups, each group being specific to one disease, such that a plurality of diseases, e.g., viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnostics can be performed, thus diminishing the risk of administering the wrong treatment to the patient.

In other cases, a disease such as a viral infection may occur without any symptoms or had caused symptoms but they faded out before the patient is presented to the medical staff. In such cases, either the patient does not seek any medical assistance, or the diagnostics are complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples.

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission links.

In some embodiments, a CRISPR system or methods of use thereof as described herein may be used to predict disease outcome in patients suffering from viral diseases. In specific embodiments, such viral diseases may include, but are not necessarily limited to, Lassa fever. Specific factors related to Lassa fever disease outcome may include but are not necessarily limited to, age, extent of kidney injury, and/or CNS injury.

Screening Microbial Genetic Perturbations

In certain example embodiments, the CRISPR systems disclosed herein may be used to screen microbial genetic perturbations. Such methods may be useful, for example to map out microbial pathways and functional networks. Microbial cells may be genetically modified and then screened under different experimental conditions. As described above, the embodiments disclosed herein can screen for multiple target molecules in a single sample, or a single target in a single individual discrete volume in a multiplex fashion. Genetically modified microbes may be modified to include a nucleic acid barcode sequence that identifies the particular genetic modification carried by a particular microbial cell or population of microbial cells. A barcode is s short sequence of nucleotides (for example, DNA, RNA, or combinations thereof) that is used as an identifier. A nucleic acid barcode may have a length of 4-100 nucleotides and be either single or double-stranded. Methods for identifying cells with barcodes are known in the art. Accordingly, guide RNAs of the CRISPR effector systems described herein may be used to detect the barcode. Detection of the positive detectable signal indicates the presence of a particular genetic modification in the sample. The methods disclosed herein may be combined with other methods for detecting complimentary genotype or phenotypic readouts indicating the effect of the genetic modification under the experimental conditions tested. Genetic modifications to be screened may include, but are not limited to, a gene knock-in, a gene knock-out, inversions, translocations, transpositions, or one or more nucleotide insertions, deletions, substitutions, mutations, or addition of nucleic acids encoding an epitope with a functional consequence such as altering protein stability or detection. In a similar fashion, the methods described herein may be used in synthetic biology application to screen the functionality of specific arrangements of gene regulatory elements and gene expression modules.

In certain example embodiments, the methods may be used to screen hypomorphs. Generation of hypomorphs and their use in identifying key bacterial functional genes and identification of new antibiotic therapeutics as disclosed in PCT/US2016/060730 entitled "Multiplex High-Resolution Detection of Micro-organism Strains, Related Kits, Diagnostic Methods and Screening Assays" filed Nov. 4, 2016, which is incorporated herein by reference.

The different experimental conditions may comprise exposure of the microbial cells to different chemical agents, combinations of chemical agents, different concentrations of chemical agents or combinations of chemical agents, different durations of exposure to chemical agents or combinations of chemical agents, different physical parameters, or both. In certain example embodiments the chemical agent is an antibiotic or antiviral. Different physical parameters to be screened may include different temperatures, atmospheric pressures, different atmospheric and non-atmospheric gas concentrations, different pH levels, different culture media compositions, or a combination thereof.

Screening Environmental Samples

The methods disclosed herein may also be used to screen environmental samples for contaminants by detecting the presence of target nucleic acid or polypeptides. For example, in some embodiments, the invention provides a method of detecting microbes comprising exposing a CRISPR system as described herein to a sample; activating an RNA effector protein via binding of one or more guide RNAs to one or more microbe-specific target RNAs or one or more trigger RNAs such that a detectable positive signal is produced. The positive signal can be detected and is indicative of the presence of one or more microbes in the sample. In some embodiments, the CRISPR system may be on a substrate as described herein, and the substrate may be exposed to the sample. In other embodiments, the same CRISPR system, and/or a different CRISPR system may be applied to multiple discrete locations on the substrate. In further embodiments, the different CRISPR system may detect a different microbe at each location. As described in further detail above, a substrate may be a flexible materials substrate, for example, including, but not limited to, a paper substrate, a fabric substrate, or a flexible polymer-based substrate.

In accordance with the invention, the substrate may be exposed to the sample passively, by temporarily immersing the substrate in a fluid to be sampled, by applying a fluid to be tested to the substrate, or by contacting a surface to be tested with the substrate. Any means of introducing the sample to the substrate may be used as appropriate.

As described herein, a sample for use with the invention may be a biological or environmental sample, such as a food sample (fresh fruits or vegetables, meats), a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof. For example, household/commercial/industrial surfaces made of any materials including, but not limited to, metal, wood, plastic, rubber, or the like, may be swabbed and tested for contaminants. Soil samples may be tested for the presence of pathogenic bacteria or parasites, or other microbes, both for environmental purposes and/or for human, animal, or plant disease testing. Water samples such as freshwater samples, wastewater samples, or saline water samples can be evaluated for cleanliness and safety, and/or potability, to detect the presence of, for example, *Cryptosporidium parvum, Giardia lamblia*, or other microbial contamination. In further embodiments, a biological sample may be obtained from a source including, but not limited to, a tissue sample, saliva, blood, plasma, sera, stool, urine, sputum, mucous, lymph, synovial fluid, cerebrospinal fluid, ascites, pleural effusion, seroma, pus, or swab of skin or a mucosal membrane surface. In some particular embodiments, an environmental sample or biological samples may be crude samples and/or the one or more target molecules may not be purified or amplified from the sample prior to application of the method. Identification of microbes may be useful and/or needed for any number of applications, and thus any type of sample from any source deemed appropriate by one of skill in the art may be used in accordance with the invention.

In some embodiments, checking for food contamination by bacteria, such as *E. coli*, in restaurants or other food providers; food surfaces; testing water for pathogens like *Salmonella, Campylobacter*, or *E. coli*; also checking food quality for manufacturers and regulators to determine the purity of meat sources; identifying air contamination with pathogens such as *legionella*; checking whether beer is contaminated or spoiled by pathogens like *Pediococcus* and *Lactobacillus*; contamination of pasteurized or un-pasteurized cheese by bacteria or fungi during manufacture.

A microbe in accordance with the invention may be a pathogenic microbe or a microbe that results in food or consumable product spoilage. A pathogenic microbe may be pathogenic or otherwise undesirable to humans, animals, or plants. For human or animal purposes, a microbe may cause a disease or result in illness. Animal or veterinary applications of the present invention may identify animals infected with a microbe. For example, the methods and systems of the invention may identify companion animals with pathogens including, but not limited to, kennel cough, rabies virus, and heartworms. In other embodiments, the methods and systems of the invention may be used for parentage testing for breeding purposes. A plant microbe may result in harm or disease to a plant, reduction in yield, or alter traits such as color, taste, consistency, and odor. For food or consumable contamination purposes, a microbe may adversely affect the taste, odor, color, consistency or other commercial properties of the food or consumable product. In certain example embodiments, the microbe is a bacterial species. The bacteria may be a psychrotroph, a coliform, a lactic acid bacteria, or a spore-forming bacteria. In certain example embodiments, the bacteria may be any bacterial species that causes disease or illness, or otherwise results in an unwanted product or trait. Bacteria in accordance with the invention may be pathogenic to humans, animals, or plants.
Sample Types Appropriate samples for use in the methods disclosed herein include any conventional biological sample obtained from an organism or a part thereof, such as a plant, animal, bacteria, and the like. In particular embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms (such as plants or animals, including samples from a healthy or apparently healthy human subject or a human patient affected by a condition or disease to be diagnosed or investigated, such as an infection with a pathogenic microorganism, such as a pathogenic bacteria or virus). For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

A sample can also be a sample obtained from any organ or tissue (including a biopsy or autopsy specimen, such as a tumor biopsy) or can include a cell (whether a primary cell or cultured cell) or medium conditioned by any cell, tissue or organ. Exemplary samples include, without limitation, cells, cell lysates, blood smears, cytocentrifuge preparations, cytology smears, bodily fluids (e.g., blood, plasma, serum, saliva, sputum, urine, bronchoalveolar lavage, semen, etc.), tissue biopsies (e.g., tumor biopsies), fine-needle aspirates, and/or tissue sections (e.g., cryostat tissue sections and/or paraffin-embedded tissue sections). In other examples, the sample includes circulating tumor cells (which can be identified by cell surface markers). In particular examples, samples are used directly (e.g., fresh or frozen), or can be manipulated prior to use, for example, by fixation (e.g., using formalin) and/or embedding in wax (such as formalin-fixed paraffin-embedded (FFPE) tissue samples). It will be appreciated that any method of obtaining tissue from a subject can be utilized, and that the selection of the method used will depend upon various factors such as the type of tissue, age of the subject, or procedures available to the practitioner. Standard techniques for acquisition of such samples are available in the art. See, for example Schluger et al., *J. Exp. Med.* 176:1327-33 (1992); Bigby et al., *Am. Rev. Respir. Dis.* 133:515-18 (1986); Kovacs et al., *NEJM* 318:589-93 (1988); and Ognibene et al., *Am. Rev. Respir. Dis.* 129:929-32 (1984).

In other embodiments, a sample may be an environmental sample, such as water, soil, or a surface such as industrial or medical surface. In some embodiments, methods such as disclosed in US patent publication No. 2013/0190196 may be applied for detection of nucleic acid signatures, specifically RNA levels, directly from crude cellular samples with a high degree of sensitivity and specificity. Sequences specific to each pathogen of interest may be identified or selected by comparing the coding sequences from the pathogen of interest to all coding sequences in other organisms by BLAST software.

Several embodiments of the present disclosure involve the use of procedures and approaches known in the art to successfully fractionate clinical blood samples. See, e.g., the procedure described in Han Wei Hou et al., *Microfluidic Devices for Blood Fractionation*, Micromachines 2011, 2, 319-343; Ali Asgar S. Bhagat et al., *Dean Flow Fractionation* (DFF) *Isolation of Circulating Tumor Cells (CTCs) from Blood*, 15$^{th}$ International Conference on Miniaturized Systems for Chemistry and Life Sciences, Oct. 2-6, 2011, Seattle, WA; and International Patent Publication No. WO2011109762, the disclosures of which are herein incorporated by reference in their entirety. Blood samples are commonly expanded in culture to increase sample size for testing purposes. In some embodiments of the present invention, blood or other biological samples may be used in methods as described herein without the need for expansion in culture.

Further, several embodiments of the present disclosure involve the use of procedures and approaches known in the art to successfully isolate pathogens from whole blood using spiral microchannel, as described in Han Wei Hou et al., Pathogen Isolation from Whole Blood Using Spiral Microchannel, Case No. 15995JR, Massachusetts Institute of Technology, manuscript in preparation, the disclosure of which is herein incorporated by reference in its entirety.

Owing to the increased sensitivity of the embodiments disclosed herein, in certain example embodiments, the assays and methods may be run on crude samples or samples where the target molecules to be detected are not further fractionated or purified from the sample.

Example Microbes

The embodiment disclosed herein may be used to detect a number of different microbes. The term microbe as used herein includes bacteria, fungus, protozoa, parasites and viruses.

Bacteria

The following provides an example list of the types of microbes that might be detected using the embodiments disclosed herein. In certain example embodiments, the microbe is a *bacterium*. Examples of bacteria that can be detected in accordance with the disclosed methods include without limitation any one or more of (or any combination of) *Acinetobacter baumanii, Actinobacillus* sp., Actinomycetes, *Actinomyces* sp. (such as *Actinomyces israelii* and *Actinomyces naeslundii*), *Aeromonas* sp. (such as *Aeromonas hydrophila, Aeromonas veronii biovar sobria (Aeromonas sobria)*, and *Aeromonas caviae*), *Anaplasma phagocytophilum, Anaplasma marginale Alcaligenes xylosoxidans, Acinetobacter baumanii, Actinobacillus actinomycetemcomitans, Bacillus* sp. (such as *Bacillus anthracis, Bacillus cereus, Bacillus subtilis, Bacillus thuringiensis,* and *Bacillus stearothermophilus*), *Bacteroides* sp. (such as *Bacteroides fragilis*), *Bartonella* sp. (such as *Bartonella bacilliformis* and *Bartonella henselae, Bifidobacterium* sp., *Bordetella* sp. (such as *Bordetella pertussis, Bordetella parapertussis,* and *Bordetella bronchiseptica*), *Borrelia* sp. (such as *Borrelia recurrentis,* and *Borrelia burgdorferi*), *Brucella* sp. (such as *Brucella abortus, Brucella canis, Brucella melintensis* and *Brucella suis*), *Burkholderia* sp. (such as *Burkholderia pseudomallei* and *Burkholderia cepacia*), *Campylobacter* sp. (such as *Campylobacter jejuni, Campylobacter coli, Campylobacter lari* and *Campylobacter fetus*), *Capnocytophaga* sp., *Cardiobacterium hominis, Chlamydia trachomatis, Chlamydophila pneumoniae, Chlamydophila psittaci, Citrobacter* sp. *Coxiella burnetii, Corynebacterium* sp. (such as, *Corynebacterium diphtheriae, Corynebacterium jeikeum* and *Corynebacterium*), *Clostridium* sp. (such as *Clostridium perfringens, Clostridium difficile, Clostridium botulinum* and *Clostridium tetani*), *Eikenella* corrodens, *Enterobacter* sp. (such as *Enterobacter aerogenes, Enterobacter agglomerans, Enterobacter cloacae* and *Escherichia coli,* including opportunistic *Escherichia coli,* such as enterotoxigenic *E. coli,* enteroinvasive *E. coli,* enteropathogenic *E. coli,* enterohemorrhagic *E. coli,* enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chafeensia* and *Ehrlichia canis*), *Epidermophyton floccosum, Erysipelothrix rhusiopathiae, Eubacterium* sp., *Francisella tularensis, Fusobacterium nucleatum, Gardnerella vaginalis, Gemella morbillorum, Haemophilus* sp. (such as *Haemophilus influenzae, Haemophilus ducreyi, Haemophilus aegyptius, Haemophilus parainfluenzae, Haemophilus haemolyticus* and *Haemophilus parahaemolyticus*), *Helicobacter* sp. (such as *Helicobacter pylori, Helicobacter cinaedi* and *Helicobacter fennelliae*), *Kingella kingii, Klebsiella* sp. (such as *Klebsiella pneumoniae, Klebsiella granulomatis* and *Klebsiella oxytoca*), *Lactobacillus* sp., *Listeria monocytogenes, Leptospira interrogans, Legionella pneumophila, Leptospira interrogans, Peptostreptococcus* sp., *Mannheimia hemolytica, Microsporum canis, Moraxella catarrhalis, Morganella* sp., *Mobiluncus* sp., *Micrococcus* sp., *Mycobacterium* sp. (such as *Mycobacterium leprae, Mycobacterium tuberculosis, Mycobacterium paratuberculosis, Mycobacterium intracellulare, Mycobacterium avium, Mycobacterium bovis,* and *Mycobacterium marinum*), *Mycoplasm* sp. (such as *Mycoplasma pneumoniae, Mycoplasma hominis,* and *Mycoplasma genitalium*), *Nocardia* sp. (such as *Nocardia asteroides, Nocardia cyriacigeorgica* and *Nocardia brasiliensis*), *Neisseria* sp. (such as *Neisseria gonorrhoeae* and *Neisseria meningitidis*), *Pasteurella multocida, Pityrosporum orbiculare (Malassezia furfur), Plesiomonas shigelloides. Prevotella* sp., *Porphyromonas* sp., *Prevotella melaninogenica, Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionibacterium acnes, Rhodococcus equi, Rickettsia* sp. (such as *Rickettsia rickettsii, Rickettsia akari* and *Rickettsia prowazekii, Orientia tsutsugamushi* (formerly: *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella cholerasuis* and *Salmonella typhimurium*), *Serratia* sp. (such as *Serratia marcesans* and *Serratia liquifaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus hemolyticus, Staphylococcus saprophyticus*), *Streptococcus* sp. (such as *Streptococcus pneumoniae* (for example chloramphenicol-resistant serotype 4 *Streptococcus pneumoniae,* spectinomycin-resistant serotype 6B *Streptococcus pneumoniae,* streptomycin-resistant serotype 9V *Streptococcus pneumoniae,* erythromycin-resistant serotype 14 *Streptococcus pneumoniae,* optochin-resistant serotype 14 *Streptococcus pneumoniae,* rifampicin-resistant serotype 18C *Streptococcus pneumoniae,* tetracycline-resistant serotype 19F *Streptococcus pneumoniae,* penicillin-resistant serotype 19F *Streptococcus pneumoniae,* and trimethoprim-resistant serotype 23F *Streptococcus pneumoniae,* chloramphenicol-resistant serotype 4 *Streptococcus pneumoniae,* spectinomycin-resistant serotype 6B *Streptococcus pneumoniae,* streptomycin-resistant serotype 9V *Streptococcus pneumoniae,* optochin-resistant serotype 14 *Streptococcus pneumoniae,* rifampicin-resistant serotype 18C *Streptococcus pneumoniae,* penicillin-resistant serotype 19F *Streptococcus pneumoniae,* or trimethoprim-resistant serotype 23F *Streptococcus pneumoniae*), *Streptococcus agalactiae, Streptococcus mutans, Streptococcus pyogenes,* Group A streptococci, *Streptococcus pyogenes,* Group B streptococci, *Streptococcus agalactiae,* Group C streptococci, *Streptococcus anginosus, Streptococcus equismilis,* Group D streptococci, *Streptococcus bovis,* Group F streptococci, and *Streptococcus anginosus* Group G streptococci), *Spirillum minus, Streptobacillus moniliformi, Treponema* sp. (such as *Treponema carateum, Treponema petenue, Treponema pallidum* and *Treponema endemicum, Trichophyton rubrum, T. mentagrophytes, Tropheryma whippeii, Ureaplasma urealyticum, Veillonella* sp., *Vibrio* sp. (such as *Vibrio cholerae, Vibrio parahemolyticus, Vibrio vulrificus, Vibrio parahaemolyticus, Vibrio vulnificus, Vibrio alginolyticus, Vibrio mimicus, Vibrio hollisae, Vibrio fluvialis, Vibrio metchnikovii, Vibrio damsela* and *Vibriofurnisii*), *Yersinia* sp. (such as *Yersinia enterocolitica, Yersinia pestis,* and *Yersinia pseudotuberculosis*) and *Xanthomonas maltophilia* among others.

Fungi

In certain example embodiments, the microbe is a fungus or a fungal species. Examples of fungi that can be detected in accordance with the disclosed methods include, without limitation, any one or more of (or any combination of),

*Aspergillus, Blastomyces*, Candidiasis, *Coccidiodomycosis, Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix*, fungal eye infections ringworm, *Exserohilum, Cladosporium*.

In certain example embodiments, the fungus is a yeast. Examples of yeast that can be detected in accordance with disclosed methods include, without limitation, one or more of (or any combination of) *Aspergillus* species (such as *Aspergillus fumigatus, Aspergillus flavus* and *Aspergillus clavatus*), *Cryptococcus* sp. (such as *Cryptococcus neoformans, Cryptococcus gattii, Cryptococcus laurentii* and *Cryptococcus albidus*), a *Geotrichum* species, a *Saccharomyces* species, a *Hansenula* species, a *Candida* species (such as *Candida albicans*), a *Kluyveromyces* species, a *Debaryomyces* species, a *Pichia* species, or combination thereof. In certain example embodiments, the fungi are a mold. Example molds include, but are not limited to, a *Penicillium* species, a *Cladosporium* species, a *Byssochlamys* species, or a combination thereof.

Protozoa

In certain example embodiments, the microbe is a protozoan. Examples of protozoa that can be detected in accordance with the disclosed methods and devices include, without limitation any one or more of (or any combination of), Euglenozoa, Heterolobosea, Diplomonadida, Amoebozoa, Blastocystic, and Apicomplexa. Example Euglenoza include, but are not limited to, *Trypanosoma cruzi* (Chagas disease), *T. brucei* gambiense, *T. brucei* rhodesiense, *Leishmania braziliensis, L. infantum, L. mexicana, L. major, L. tropica*, and *L. donovani*. Example Heterolobosea include, but are not limited to, *Naegleria fowleri*. Example Diplomonadid include, but are not limited to, *Giardia intestinalis* (*G. lamblia, G. duodenalis*). Example Amoebozoa include, but are not limited to, *Acanthamoeba castellanii, Balamuthia madrillaris, Entamoeba histolytica*. Example *Blastocystis* include, but are not limited to, *Blastocystis hominis*. Example Apicomplexa include, but are not limited to, *Babesia microti, Cryptosporidium parvum, Cyclospora cayetanensis, Plasmodium falciparum, P. vivax, P. ovale, P. malariae*, and *Toxoplasma gondii.Babesia microti, Cryptosporidium parvum, Cyclospora cayetanensis, Plasmodium falciparum, P. vivax, P. ovale, P. malariae*, and *Toxoplasma gondii*.

Parasites

In certain example embodiments, the microbe is a parasite. Examples of parasites that can be detected in accordance with disclosed methods include without limitation one or more of (or any combination of), an *Onchocerca* species and a *Plasmodium* species.

Viruses

In certain example embodiments, the systems, devices, and methods, disclosed herein are directed to detecting viruses in a sample. The embodiments disclosed herein may be used to detect viral infection (e.g., of a subject or plant), or determination of a viral strain, including viral strains that differ by a single nucleotide polymorphism. The virus may be a DNA virus, an RNA virus, or a retrovirus. Non-limiting example of viruses useful with the present invention include, but are not limited to, Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the viral sequence may be a human respiratory syncytial virus, Sudan ebola virus, Bundibugyo virus, Tai Forest ebola virus, Reston ebola virus, Achimota, *Aedes* flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyoxivirus, Australian bat lyssavirus, Avian bornavirus, Avian metapneumovirus, Avian paramyoxviruses, penguin or Falkland Islandsvirus, BK polyomavirus, Bagaza virus, Banna virus, Bat hepevirus, Bat sapovirus, Bear Canon mammarenavirus, Beilong virus, Betacoronoavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwere virus, Caliciviridae virus. California encephalitis virus, Candiru virus, Canine distemper virus, Canaine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, *Culex* flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyoxivirus SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human gential-associated circular DNA virus-1, Human herpesvirus 1-8, Human immunodeficiency virus 1/2, Huan mastadenovirus A-G, Human papillomavirus, Human parainfluenza virus 1-4, Human paraechovirus, Human picobirnavirus, Human smacovirus, Ikoma lyssavirus, Ilheus virus, Influenza A-C, Ippy mammarenavirus, Irkut virus, J-virus, JC polyomavirus, Japanses encephalitis virus, Junin mammarenavirus, KI polyomavirus, Kadipiro virus, Kamiti River virus, Kedougou virus, Khujand virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, *Montana myotis* leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Procine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno *canis* virus, Torque teno douroucouli virus, Torque teno *felis* virus, Torque teno midi virus, Torque teno sus virus, Torque teno tamarin virus, Torque teno virus, Torque teno *zalophus* virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis mosaic* virus (ArMV), or *Rupestris* stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is, thus, preferred that the CRISPR system is capable of cleaving the target RNA molecule from the plant pathogen both when the CRISPR system (or parts needed for its completion) is applied therapeutically, i.e, after infection has occurred or prophylactically, i.e., before infection has occurred.

In certain example embodiments, the virus may be a retrovirus. Example retroviruses that may be detected using the embodiments disclosed herein include one or more of or any combination of viruses of the Genus *Alpharetrovirus, Betaretrovirus, Gammaretrovirus, Deltaretrovirus, Epsilonretrovirus, Lentivirus, Spumavirus*, or the Family Metaviridae, Pseudoviridae, and Retroviridae (including HIV), Hepadnaviridae (including Hepatitis B virus), and Caulimoviridae (including Cauliflower *mosaic* virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zozter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among oIn some embodiments, a method of diagnosing a species-specific bacterial infection in a subject suspected of having a bacterial infection is described as obtaining a sample comprising bacterial ribosomal ribonucleic acid from the subject; contacting the sample with one or more of the probes described, and detecting hybridization between the bacterial ribosomal ribonucleic acid sequence present in the sample and the probe, wherein the detection of hybridization indicates that the subject is infected with *Escherichia coli, Klebsiella pneumoniae, Pseudomonas aeruginosa, Staphylococcus aureus, Acinetobacter baumannii, Candida albicans, Enterobacter cloacae, Enterococcus faecalis, Enterococcus faecium, Proteus mirabilis, Staphylococcus agalactiae*, or *Staphylococcus maltophilia* or a combination thereof.

In certain example embodiments, the virus is a virus listed in Table 8 below, or a virus of the indicated genus/family.

TABLE 8

| Virus | Genus, Family | Host | Transmission | Disease |
|---|---|---|---|---|
| Adeno-associated virus | Dependovirus | Human, vertebrates | Respiratory | None |

TABLE 8-continued

| Virus | Genus, Family | Host | Transmission | Disease |
|---|---|---|---|---|
| Aichi virus | Kobuvirus, Picornaviridae | Human | Fecal-oral | Gastroenteritis |
| Australian bat lyssavirus | Lyssavirus, Rhabdoviridae | Human, bats | Zoonosis, animal bite | Fatal encephalitis |
| BK polyomavirus | Polyomavirus, Polyomaviridae | Human | Respiratory fluids or urine | None |
| Banna virus | Seadornavirus, Reoviridae | Human, cattle, pig, mosquitoes | Zoonosis, arthropod bite | Encephalitis |
| Barmah forest virus | Alphavirus, Togaviridae | Human, marsupials, mosquitoes | Zoonosis, arthropod bite | Fever, joint pain |
| Bunyamwera virus | Orthobunyavirus, Bunyaviridae | Human, mosquitoes | Zoonosis, arthropod bite | Encephalitis |
| Bunyavirus La Crosse | Orthobunyavirus, Bunyaviridae | Human, deer, mosquitoes, tamias | Zoonosis, arthropod bite | Encephalitis |
| Bunyavirus snowshoe hare | Orthobunyavirus, Bunyaviridae | Human, rodents, mosquitoes | Zoonosis, arthropod bite | Encephalitis |
| Cercopithecine herpesvirus | Lymphocryptovirus, Herpesviridae | Human, monkeys | Zoonosis, animal bite | Encephalitis |
| Chandipura virus | Vesiculovirus, Rhabdoviridae | Human, sandflies | Zoonosis, athropod bite | Encephalitis |
| Chikungunya virus | Alphavirus, Togaviridae | Human, monkeys, mosquitoes | Zoonosis, arthropod bite | Fever, joint pain |
| Cosavirus A | Cosavirus, Picornaviridae | Human | Fecal-oral (probable) | — |
| Cowpox virus | Orthopoxvirus, Poxviridae | Human, mammals | Zoonosis, contact | None |
| Coxsackievirus | Enterovirus, Picornaviridae | Human | Fecal-oral | Meningitis, myocarditis, paralysis |
| Crimean-Congo hemorrhagic fever virus | Nairovirus, Bunyaviridae | Human, vertebrates, ticks | Zoonosis, arthropod bite | Hemorrhagic fever |
| Dengue virus | Flavivirus, Flaviviridae | Human, mosquitoes | Zoonosis, arthropod bite | Hemorrhagic fever |
| Dhori virus | Thogotovirus, Orthomyxoviridae | Human, ticks | Zoonosis, arthropod bite | Fever, encephalitis |
| Dugbe virus | Nairovirus, Bunyaviridae | Human, ticks | Zoonosis, arthropod bite | Thrombocytopaenia |
| Duvenhage virus | Lyssavirus, Rhabdoviridae | Human. mammals | Zoonosis, animal bite | Fatal encephalitis |
| Eastern equine encephalitis virus | Alphavirus, Togaviridae | Human, birds, mosquitoes | Zoonosis, arthropod bite | Encephalitis |
| Ebolavirus | Ebolavirus, Filoviridae | Human, monkeys, bats | Zoonosis, contact | Hemorrhagic fever |
| Echovirus | Enterovirus, Picornaviridae | Human | Fecal-oral | Common cold |
| Encephalomyocarditis virus | Cardiovirus, Picornaviridae | Human, mouse, rat. pig | Zoonosis | Encephalitis |
| Epstein-Barr virus | Lymphocryptovirus, Herpesviridae | Human | Contact, saliva | Mononucleosis |
| European bat lyssavirus | Lyssavirus, Rhabdovirus | Human, bats | Zoonosis, animal bite | Fatal encephalitis |
| GB virus C/Hepatitis G virus | Pegivirus, Flaviviridae | Human | Blood, occasionally sexual | None |
| Hantaan virus | Hantavirus, Bunyaviridae | Human, rodents | Zoonosis, urine, saliva | Renal or respiratory syndrome |
| Hendra virus | Henipavirus, paramyxoviridae | Human, horse, bats | Zoonosis, animal bite | Encephalitis |
| Hepatitis A virus | Hepatovirus, picornaviridae | Human | Fecal-oral | Hepatitis |
| Hepatitis B virus | Orthohepadnavirus, Hepadnaviridae | Human, Chimpanzees | Sexual contact, blood | Hepatitis |
| Hepatitis C virus | Hepacivirus, Flaviviridae | Human | Sexual, blood | Hepatitis |
| Hepatitis E virus | Hepevirus, Unassigned | Human, pig, monkeys, some rodents, chicken | Zoonosis, food | Hepatitis |
| Hepatitis delta virus | Deltavirus, Unassigned | Human | Sexual contact, blood | Hepatitis |
| Horsepox virus | Orthopoxvirus, Poxviridae | Human, horses | Zoonosis, contact | None |

TABLE 8-continued

| Virus | Genus, Family | Host | Transmission | Disease |
|---|---|---|---|---|
| Human adenovirus | Mastadenovirus, Adenoviridae | Human | Respiratory, fecal-oral | Respiratory |
| Human astrovirus | Mamastrovirus, Astroviridae | Human | Fecal-oral | Gastroenteritis |
| Human coronavirus | Alphacoronavirus, Coronaviridae | Human | Respiratory | Respiratory |
| Human cytomegalovirus | Cytomegalovirus, Herpesviridae | Human | Contact, urine, saliva | Mononucleosis, pneumonia |
| Human enterovirus 68, 70 | Enterovirus, Picornaviridae | Human | Fecal-oral | Diarrhea, neurological disorder |
| Human herpesvirus 1 | Simplexvirus, Herpesviridae | Human | Sexual contact, saliva | Skin lesions |
| Human herpesvirus 2 | Simplexvirus, Herpesviridae | Human | Sexual contact, saliva | Skin lesions |
| Human herpesvirus 6 | Roseolovirus, Herpesviridae | Human | Respiratory. contact | Skin lesions |
| Human herpesvirus 7 | Roseolovirus, Herpesviridae | Human | Respiratory, contact | Skin lesions |
| Human herpesvirus 8 | Rhadinovirus, Herpesviridae | Human | Sexual contact, saliva | Skin lymphoma |
| Human immunodeficiency virus | Lentivirus, Retroviridae | Human | Sexual contact, blood | AIDS |
| Human papillomavirus 1 | Mupapillomavirus, Papillomaviridae | Human | Contact | Skin warts |
| Human papillomavirus 2 | Alphapapillomavirus, Papillomaviridae | Human | Contact | Skin warts |
| Human papillomavirus 16, 18 | Alphapapillomavirus, Papillomaviridae | Human | Sexual | Genital warts, cervical cancer |
| Human parainfluenza | Respirovirus, Paramyxoviridae | Human | Respiratory | Respiratory |
| Human parvovirus B19 | Erythrovirus, Parvoviridae | Human | Respiratory | Skin lesion |
| Human respiratory syncytial virus | Pneumovirus, Paramyxoviridae | Human | Respiratory | Respiratory |
| Human rhinovirus | Enterovirus | Human | Respiratory | Respiratory |
| Human SARS coronavirus | Betacoronavirus, Coronaviridae | Human, palm civet | Zoonosis | Respiratory |
| Human spumaretrovirus | Spumavirus, Retroviridae | Human | Contact, saliva | None |
| Human T-lymphotropic virus | Deltaretrovirus, Retroviridae | Human | Sexual contact, maternal-neonatal | Leukemia |
| Human torovirus | Torovirus, Coronaviridae | Human | Fecal-oral | Gastroenteritis |
| Influenza A virus | Influenzavirus A, Orthomyxoviridae | Human, birds, pigs | Respiratory or Zoonosis, animal contact | Flu |
| Influenza B virus | Influenzavirus B, Orthomyxoviridae | Human | Respiratory | Flu |
| Influenza C virus | Influenzavirus C, Orthomyxoviridae | Human | Respiratory | Flu |
| Isfahan virus | Vesiculovirus, Rhabdoviridae | Human, sandflies, gerbils | Zoonosis, arthropod bite | Undocumented, encephalitis? |
| JC polyomavirus | Polyomavirus, Polyomaviridae | Human | Fecal-oral or urine | Encephalitis |
| Japanese encephalitis virus | Flavivirus, Flaviviridae | Human, horses, birds, mosquitoes | Zoonosis, arthropod borne | Encephalitis |
| Junin arenavirus | Arenavirus, Arenaviridae | Human, rodents | Zoonosis, fomite | Hemorrhagic fever |
| KI Polyomavirus | Polyomavirus, Polyomaviridae | Human | Fecal-oral or urine | Encephalitis |
| Kunjin virus | Flavivirus, Flaviviridae | Human, horses, birds, mosquitoes | Zoonosis, arthropod borne | Encephalitis |
| Lagos bat virus | Lyssavirus, Rhabdoviridae | Human, mammals | Zoonosis, animal bite | Fatal encephalitis |
| Lake Victoria marburgvirus | Marburgvirus, Filoviridae | Human, monkeys, bats | Zoonosis, fomite | Hemorrhagic fever |
| Langat virus | Flavivirus, Flaviviridae | Human, ticks | Zoonosis, arthropod borne | Encephalitis |

TABLE 8-continued

| Virus | Genus, Family | Host | Transmission | Disease |
|---|---|---|---|---|
| Lassa virus | Arenavirus, Arenaviridae | Human, rats | Zoonosis, fomites | Hemorrhagic fever |
| Lordsdale virus | Norovirus, Caliciviridae | Human | Fecal-oral | Gastroenteritis |
| Louping ill virus | Flavivirus, Flaviviridae | Human, mammals, ticks | Zoonosis, arthropod bite | Encephalitis |
| Lymphocytic choriomeningitis virus | Arenavirus, Arenaviridae | Human, rodents | Zoonosis, fomite | Encephalitis |
| Machupo virus | Arenavirus, Arenaviridae | Human, monkeys, mouse | Zoonosis, fomite | Encephalitis |
| Mayaro virus | Alphavirus, Togaviridae | Human, mosquitoes | Zoonosis, arthropod bite | Fever, joint pain |
| MERS coronavirus | Betacoronavirus, Coronaviridae | Human, Tomb bat | Zoonosis | Respiratory |
| Measles virus | Morbilivirus, Paramyxoviridae | Human | Respiratory | Fever, rash |
| Mengo encephalomyocarditis virus | Cardiovirus, Picornaviridae | Human, mouse, rabbit | Zoonosis | Encephalitis |
| Merkel cell polyomavirus | Polyomavirus, Polyomaviridae | Human | — | Merkel cell carcinoma |
| Mokola virus | Lyssavirus, Rhabdoviridae | Human, rodents, cat, dog shrew | Zoonosis, animal bite | Encephalitis |
| Molluscum contagiosiun virus | Molluscipoxvirus, Poxviridae | Human | Contact | Skin lesions |
| Monkeypox virus | Orthopoxvirus | Human, mouse, prairie dog | Zoonosis, contact | Skin lesions |
| Mumps virus | Rubulavirus, Paramyxoviridae | Human | Respiratory, saliva | Mumps |
| Murray valley encephalitis virus | Flavivirus | Human, mosquitoes | Zoonosis, arthropod bite | Encephalitis |
| New York virus | Hantavirus, Bunyavirus | Human, mouse | Zoonosis, urine, saliva | Hemorrhagic fever |
| Nipah virus | Henipavirus, Paramyxoviridae | Human, bats | Zoonosis, animal bite | Encephalitis |
| Norwalk virus | Norovirus, Caliciviridae | Human | Fecal-oral | Gastroenteritis |
| O'nyong-nyong virus | Alphavirus, Togaviridae | Human, mosquitoes | Zoonosis, arthropod bite | Fever, joint pain |
| Orf virus | Parapoxvirus, Poxviridae | Human, mammals | Zoonosis, contact | Skin lesions |
| Oropouche virus | Orthobunyavirus | Human, wild animals(sloths) | Zoonosis, arthropod bite | Fever, joint pain |
| Pichinde virus | Arenavirus, Arenaviridae | Human, rat, guinea pig | Zoonosis, fomite | Hemorrhagic fever |
| Poliovirus | Enterovirus, Picornaviridae | Human, mammals | Fecal-oral | Poliomyelitis |
| Punta toro phlebovirus | Phlebovirus, Bunyaviridae | Human, sandflies | Zoonosis, arthropod bite | Hemorrhagic fever |
| Puumala virus | Hantavirus, Bunyavirus | Human, bank vole | Zoonosis, urine, saliva | Hemorrhagic fever |
| Rabies virus | Lyssavirus, Rhabdoviridae | Human, mammals | Zoonosis, animal bite | Fatal encephalitis |
| Rift valley fever virus | Phlebovirus, Bunyaviridae | Human, mammals, mosquitoes, sandflies | Zoonosis, arthropod bite | Hemorrhagic fever |
| Rosavirus A | Rosavirus, Picornaviridae | Human | | |
| Ross river virus | Alphavirus, Togaviridae | Human, mosquitoes, marsupials | Zoonosis, arthropod bite | Fever, joint pain |
| Rotavirus A | Rotavirus, Reoviridae | Human | Fecal-oral | Gastroenteritis |
| Rotavirus B | Rotavirus, Reoviridae | Human | Fecal-oral | Gastroenteritis |
| Rotavirus C | Rotavirus, Reoviridae | Human | Fecal-oral | Gastroenteritis |
| Rubella virus | Rubivirus, Togaviridae | Human | Respiratory | Rubella |
| Sagiyama virus | Alphavirus, Togaviridae | Human, horse, pig, mosquitoes | Zoonosis, arthropod bite | Fever, joint pain |

TABLE 8-continued

| Virus | Genus, Family | Host | Transmission | Disease |
|---|---|---|---|---|
| Salivirus A | Salivirus, Picornaviridae | Human | | Gastroenteritis |
| Sandfly fever sicilian virus | Phlebovirus, Bunyaviridae | Human, sandflies | Zoonosis, arthropod bite | Hemorrhagic fever |
| Sapporo virus | Sapovirus, Caliciviridae | Human | Fecal-oral | Gastroenteritis |
| Semliki forest virus | Alphavirus, Togaviridae | Human, birds, hedgehog, mosquitoes | Zoonosis, arthropod bite | Fever, joint pain |
| Seoul virus | Hantavirus, Bunyavirus | Human, rats | Zoonosis, urine, saliva | Hemorrhagic fever |
| Simian foamy virus | Spumavirus, Retroviridae | Human, monkeys | Zoonosis, contact | None |
| Simian virus 5 | Rubulavirus, Paramyxoviridae | Human, dog | Zoonosis, contact | Undocumented |
| Sindbis virus | Alphavirus, Togaviridae | Human, birds, mosquitoes | Zoonosis, arthropod bite | Pogosta_disease Fever, joint pain |
| Southampton virus | Norovirus, Caliciviridae | Human | Fecal-oral | Gastroenteritis |
| St. louis encephalitis virus | Flavivirus, Flaviviridae | Human, birds, mosquitoes | Zoonosis, arthropod bite | Encephalitis |
| Tick-borne powassan virus | Flavivirus, Flaviviridae | Human, ticks | Zoonosis, arthropod bite | Encephalitis |
| Torque teno virus | Alphatorquevirus | Human | Sexual, blood | None |
| Toscana virus | Phlebovirus, Bunyaviridae | Human, mosquitoes | Zoonosis, arthropod bite | Hemorrhagic fever |
| Uukuniemi virus | Phlebovirus, Bunyaviridae | Human, ticks | Zoonosis, arthropod bite | Hemorrhagic fever |
| Vaccinia virus | Orthopoxvirus, Poxviridae | Human, mammals | Contact | None |
| Varicella-zoster virus | Varicellovirus, Herpesviridae | Human | Respiratory, contact | Varicella |
| Variola virus | Orthopoxvirus, Poxviridae | Human | Respiratory | Variola |
| Venezuelan equine encephalitis virus | Alphavirus, Togaviridae | Human, rodents, mosquitoes | Zoonosis, arthropod bite | Fever, joint pain |
| Vesicular stomatitis virus | Vesiculovirus, Rhabdoviridae | Human, cattle, horse, pig, flies | Zoonosis, athropod bite | Encephalitis |
| Western equine encephalitis virus | Alphavirus, Togaviridae | Human, vertebrates, mosquitoes | Zoonosis, arthropod bite | Fever, joint pain |
| WU polyomavirus | Polyomavirus, Polyomaviridae | Human | Respiratory fluids or urine | None |
| West Nile virus | Flavivirus, Flaviviridae | Human, birds, ticks, mosquitoes | Zoonosis, arthropod bite | Hemorrhagic fever |
| Yaba monkey tumor virus | Orthopoxvirus, Poxviridae | Human, monkeys | Zoonosis, contact | None |
| Yaba-like disease virus | Orthopoxvirus, Poxviridae | Human, monkeys | Zoonosis, contact | None |
| Yellow fever virus | Flavivirus, Flaviviridae | Human, monkeys, mosquitoes | Zoonosis, arthropod bite | Hemorrhagic fever |
| Zika virus | Flavivirus, Flaviviridae | Human, monkeys, mosquitoes | Zoonosis, arthropod bite | Fever, joint pain, rash |

In certain embodiments, the virus is the virus is a virus listed in the Table below.

| Virus | Tissue/cell type | Citation |
|---|---|---|
| Lassa virus | DCs, vascular endothelial cells | Kunz, S. et. al. 2005. *Journal of Virology*. |
| Ebola virus | Numerous (DCs, macrophages, hepatocytes, etc.) | Martines, R. B. et. al. 2015. *Journal of Pathology*. |
| SARS-CoV | Lung | To, K F. et. al. 2004. *Journal of Pathology*. |
| Zika | Numerous (bodily fluids, placenta, brain, etc.) | Miner, J. J. & Diamond, M. S. 2017. *Cell Host & Microbe*. |
| Dengue | Numerous (DCs, macrophages, liver, etc.) | Flipse, J. et. al. 2016. *Journal of General Virology*. |

-continued

| Virus | Tissue/cell type | Citation |
|---|---|---|
| Chikungunya | Numerous (immune cells, liver, central nervous system, etc.) | Schwartz, O. & Albert, M. L. 2010. *Nature Reviews*. |
| Influenza | Lung epithelial cells or macrophages | Medina, R. A. & Garcia-Sastre A. 2011 *Nature Reviews*. |
| HIV | T cells, macrophages | Weiss, R. A. 2002. *IUBMB Life*. |
| Rotavirus | Intestine | Lopez, S & Arias. C. F. 2006. *CTMI* |
| Herpes Simplex (HSV-1) | Epithelial cells, neuronal cells | Schelhaas. M. et. al. 2003. *Journal of General Virology*. |
| HCV | Liver | Ding, Q, et. al. 2014. *Cell Host & Microbe*. |
| HBV | Liver | Schieck. A. et. al. 2013. *Hepatology*. |

In certain embodiments, the virus is a virus listed in Table 9 below.

TABLE 9

List of Viruses with FDA-Approved Vaccines (15-16):

1. Adenovirus
2. Hepatitis A
3. Hepatitis B
4. Human Papillomavirus (HPV)
5. Influenza
6. Japanese Encephalitis Virus
7. Measles
8. Mumps
9. Polio
10. Rabies
11. Rotavirus
12. Rubella
13. Shingles/Zoster (HSV)
14. Smallpox*
15. Varicella (Chicken Pox)
16. Yellow Fever List of Viruses with FDA-Approved Antiviral Drugs (9):

1. Cytomegalovirus
2. Human Immunodeficiency Virus (HIV)
3. Hepatitis B
4. Hepatitis C
5. Influenza
6. Respiratory Syncytial Virus
7. Human Papillomavirus (HPV)
8. Herpes Simplex Virus (Shingles)
9. Varicella Zoster Virus (Chicken pox)

List of Viruses with FDA-Approved Nucleic Acid Diagnostics (11):

1. Adenovirus
2. Cytomegalovirus
3. Dengue
4. Enterovirus
5. Herpes Simplex Virus
6. Hepatitis B
7. Hepatitis C
8. Human Metapneumovirus
9. Human Papillomavirus
10. Influenza
11. Respiratory Syncytial Virus In certain embodiments, the virus is a drug resistant virus. By means of example, and without limitation, the virus may be a ribavirin resistant virus. Ribavirin is a very effective antiviral that hits a number of RNA viruses. Below are a few important viruses that have evolved ribavirin resistance. Foot and Mouth Disease Virus: doi:10.1128/JVI.03594-13. Polio virus: pnas.org/content/100/12/7289.full.pdf. Hepatitis C Virus: jvi.asm.org/content/79/4/2346.full. A number of other persistent RNA viruses, such as hepatitis and HIV, have evolved resistance to existing antiviral drugs. Hepatitis B Virus (lamivudine, tenofovir, entecavir): doi:10.1002/hep.22900. Hepatitis C Virus (Telaprevir, BILN2061, ITMN-191, SCH6, Boceprevir, AG-021541, ACH-806): doi:10.1002/hep.22549. HIV has many drug-resistant mutations, see hivdb.stanford.edu/ for more information. Aside from drug resistance, there are a number of clinically relevant mutations that could be targeted with the CRISPR systems according to the invention as described herein. For instance, persistent versus acute infection in LCMV: doi:10.1073/pnas.1019304108; or increased infectivity of Ebola: doi.org/10.1016/j.cell.2016.10.014 and doi.org/10.1016/j.cell.2016.10.013.

Malaria Detection and Monitoring

Malaria is a mosquito-borne pathology caused by *Plasmodium* parasites. The parasites are spread to people through the bites of infected female *Anopheles* mosquitoes. Five *Plasmodium* species cause malaria in humans: *Plasmodium falciparum, Plasmodium vivax, Plasmodium ovale, Plasmodium malariae*, and *Plasmodium knowlesi*. Among them, according to the World Health Organization (WHO), *Plasmodium falciparum*; and *Plasmodium vivax* are responsible for the greatest threat. *P. falciparum* is the most prevalent malaria parasite on the African continent and is responsible for most malaria-related deaths globally. *P. vivax* is the dominant malaria parasite in most countries outside of sub-Saharan Africa.

In 2015, 91 countries and areas had ongoing malaria transmission. According to the latest WHO estimates, there were 212 million cases of malaria in 2015 and 429 000 deaths. In areas with high transmission of malaria, children under 5 are particularly susceptible to infection, illness and death; more than two thirds (70%) of all malaria deaths occur in this age group. Between 2010 and 2015, the under-5 malaria death rate fell by 29% globally. However, malaria remains a major killer of children under five years old, taking the life of a child every two minutes.

As described by the WHO, malaria is an acute febrile illness. In a non-immune individual, symptoms appear 7 days or more after the infective mosquito bite. The first symptoms—fever, headache, chills and vomiting—may be mild and difficult to recognize as malaria, however, if not treated within 24 hours, *P. falciparum* malaria can progress to severe illness, often leading to death.

Children with severe malaria frequently develop one or more of the following symptoms: severe anaemia, respiratory distress in relation to metabolic acidosis, or cerebral malaria. In adults, multi-organ involvement is also frequent. In malaria endemic areas, people may develop partial immunity, allowing asymptomatic infections to occur.

The development of rapid and efficient diagnostic tests is of high relevance for public health. Indeed, early diagnosis and treatment of malaria not only reduces disease and prevents deaths but also contributes to reducing malaria transmission. According to the WHO recommendations, all cases of suspected malaria should be confirmed using parasite-based diagnostic testing (notably using a rapid diagnostic test) before administering treatment (see "WHO Guidelines for the treatment of malaria", third edition, published in April 2015).

Resistance to antimalarial therapies represents a critical health problem which drastically reduces therapeutic strategies. Indeed, as reported on the WHO website, resistance of *P. falciparum* to previous generations of medicines, such as chloroquine and sulfadoxine/pyrimethamine (SP), became widespread in the 1950s and 1960s, undermining malaria control efforts and reversing gains in child survival. Thus, the WHO recommends the routine monitoring of antimalarial drug resistance. Indeed, accurate diagnostic may avoid non appropriate treatments and limit extension of resistance to antimalarial medicines.

In this context the WHO Global Technical Strategy for Malaria 2016-2030—adopted by the World Health Assembly in May 2015—provides a technical framework for all malaria-endemic countries. It is intended to guide and support regional and country programs as they work towards malaria control and elimination. The Strategy sets ambitious but achievable global targets, including:

Reducing malaria case incidence by at least 90% by 2030.
Reducing malaria mortality rates by at least 90% by 2030.
Eliminating malaria in at least 35 countries by 2030.
Preventing a resurgence of malaria in all countries that are malaria-free.

This Strategy was the result of an extensive consultative process that spanned 2 years and involved the participation of more than 400 technical experts from 70 Member States. It is based on 3 key axes:

ensuring universal access to malaria prevention, diagnosis and treatment;
accelerating efforts towards elimination and attainment of malaria-free status; and
transforming malaria surveillance into a core intervention.

Treatment against *Plasmodium* include aryl-amino alcohols such as quinine or quinine derivatives such as chloroquine, amodiaquine, mefloquine, piperaquine, lumefantrine, primaquine; lipophilic hydroxynaphthoquinone analog, such as atovaquone; antifolate drugs, such as the sulfa drugs sulfadoxine, dapsone and pyrimethamine; proguanil; the combination of atovaquone/proguanil; atemisins drugs; and combinations thereof.

Target sequences that are diagnostic for the presence of a mosquito-borne pathogen include sequence that diagnostic for the presence of *Plasmodium*, notably *plasmodia* species affecting humans such as *Plasmodium falciparum, Plasmodium vivax, Plasmodium ovale, Plasmodium malariae*, and *Plasmodium knowlesi*, including sequences from the genomes thereof.

Target sequences that are diagnostic for monitoring drug resistance to treatment against *Plasmodium*, notably *Plasmodia* species affecting humans such as *Plasmodium falciparum, Plasmodium vivax, Plasmodium ovale, Plasmodium malariae*, and *Plasmodium knowlesi*.

Further target sequence include sequences include target molecules/nucleic acid molecules coding for proteins involved in essential biological process for the *Plasmodium* parasite and notably transporter proteins, such as protein from drug/metabolite transporter family, the ATP-binding cassette (ABC) protein involved in substrate translocation, such as the ABC transporter C subfamily or the Na+/H+ exchanger, membrane glutathione S-transferase; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional target may also include the gene(s) coding for the heme polymerase.

Further target sequences include target molecules/nucleic acid molecules coding for proteins involved in essential biological process may be selected from the *P. falciparum* chloroquine resistance transporter gene (pfcrt), the *P. falciparum* multidrug resistance transporter 1 (pfmdr1), the *P. falciparum* multidrug resistance-associated protein gene (Pfmrp), the *P. falciparum* Na+/H+ exchanger gene (pfnhe), the gene coding for the *P. falciparum* exported protein 1, the *P. falciparum* Ca2+ transporting ATPase 6 (pfatp6); the *P. falciparum* dihydropteroate synthase (pfdhps), dihydrofolate reductase activity (pfdhpr) and dihydrofolate reductase-thymidylate synthase (pfdhfr) genes, the cytochrome b gene, gtp cyclohydrolase and the Kelch13 (K13) gene as well as their functional heterologous genes in other *Plasmodium* species.

A number of mutations, notably single point mutations, have been identified in the proteins which are the targets of the current treatments and associated with specific resistance phenotypes. Accordingly, the invention allows for the detection of various resistance phenotypes of mosquito-borne parasites, such as *plasmodium*.

The invention allows to detect one or more mutation(s) and notably one or more single nucleotide polymorphisms in target nucleic acids/molecules. Accordingly, any one of the mutations below, or their combination thereof, can be used as drug resistance marker and can be detected according to the invention.

Single point mutations in *P. falciparum* K13 include the following single point mutations in positions 252, 441, 446, 449, 458, 493, 539, 543, 553, 561, 568, 574, 578, 580, 675, 476, 469, 481, 522, 537, 538, 579, 584 and 719 and notably mutations E252Q, P441L, F446I, G449A, N458Y, Y493H, R539T, I543T, P553L, R561H, V568G, P574L, A578S, C580Y, A675V, M476I; C469Y; A481V; S522C; N537I; N537D; G538V; M579I; D584V; and H719N. These mutations are generally associated with artemisins drugs resistance phenotypes (Artemisinin and artemisinin-based combination therapy resistance, April 2016 WHO/HTM/GMP/2016.5).

In the *P. falciparum* dihydrofolate reductase (DHFR) (PfDHFR-TS, PFD0830w), important polymorphisms include mutations in positions 108, 51, 59 and 164, notably 108 D, 164L, 51I and 59R which modulate resistance to pyrimethamine. Other polymorphisms also include 437G, 581G, 540E, 436A and 613S which are associated with resistance to sulfadoxine. Additional observed mutations include Ser108Asn, Asn51Ile, Cys59Arg, Ile164Leu, Cys50Arg, Ile164Leu, Asn188Lys, Ser189Arg and Val213Ala, Ser108Thr and Ala16Val. Mutations Ser108Asn, Asn51Ile, Cys59Arg, Ile164Leu, Cys50Arg, Ile164Leu are notably associated with pyrimethamine based therapy and/or chloroguanine-dapsone combination therapy resistances. Cycloguanil resistance appears to be associated with the double mutations Ser108Thr and Ala16Val. Amplification of dhfr may also be of high relevance for therapy resistance notably pyrimethamine resistance.

In the *P. falciparum* dihydropteroate synthase (DHPS) (PfDHPS, PF08_0095), important polymorphisms include mutations in positions 436, 437, 581 and 613 Ser436Ala/Phe, Ala437Gly, Lys540Glu, Ala581Gly and Ala613Thr/Ser. Polymorphism in position 581 and/or 613 have also been associated with resistance to sulfadoxine-pyrimethamine base therapies.

In the *P. falciparum* chloroquine-resistance transporter (PfCRT), polymorphism in position 76, notably the mutation Lys76Thr, is associated with resistance to chloroquine. Further polymorphisms include Cys72Ser, Met74Ile, Asn75Glu, Ala220Ser, Gln271Glu, Asn326Ser, Ile356Thr and Arg371Ile which may be associated with chloroquine resistance. PfCRT is also phosphorylated at the residues S33, 5411 and T416, which may regulate the transport activity or specificity of the protein.

In the *P. falciparum* multidrug-resistance transporter 1 (PfMDR1) (PFE1150w), polymorphisms in positions 86, 184, 1034, 1042, notably Asn86Tyr, Tyr184-Phe, Ser1034Cys, Asn1042Asp and Asp1246Tyr have been identified and reported to influence have been reported to influence susceptibilities to lumefantrine, artemisinin, quinine, mefloquine, halofantrine and chloroquine. Additionally, amplification of PfMDR1 is associated with reduced susceptibility to lumefantrine, artemisinin, quinine, mefloquine, and halofantrine and deamplification of PfMDR1 leads to an increase in chloroquine resistance. Amplification of pfmdr1 may also be detected. The phosphorylation status of PfMDR1is also of high relevance.

In the *P. falciparum* multidrug-resistance associated protein (PfMRP) (gene reference PFA0590w), polymorphisms in positions 191 and/or 437, such as Y191H and A437S have been identified and associated with chloroquine resistance phenotypes.

In the *P. falciparum* NA+/H+ enchanger (PfNHE) (ref PF13_0019), increased repetition of the DNNND in microsatellite ms4670 may be a marker for quinine resistance.

Mutations altering the ubiquinol binding site of the cytochrome b protein encoded by the cytochrome be gene (cytb, mal_mito_3) are associated with atovaquone resistance. Mutations in positions 26,268,276, 133 and 280 and notably Tyr26Asn, Tyr268Ser, M133I and G280D may be associated with atovaquone resistance.

For example, in P. *Vivax*, mutations in PvMDR1, the homolog of Pf MDR1 have been associated with chloroquine resistance, notably polymorphism in position 976 such as the mutation Y976F.

The above mutations are defined in terms of protein sequences. However, the skilled person is able to determine the corresponding mutations, including SNPS, to be identified as a nucleic acid target sequence.

Other identified drug-resistance markers are known in the art, for example as described in "Susceptibility of *Plasmodium falciparum* to antimalarial drugs (1996-2004)"; WHO; Artemisinin and artemisinin-based combination therapy resistance (April 2016 WHO/HTM/GMP/2016.5); "Drug-resistant malaria: molecular mechanisms and implications for public health" FEBS Lett. 2011 Jun. 6; 585(11):1551-62. doi:10.1016/j.febslet.2011.04.042. Epub 2011 Apr. 23. Review. PubMed PMID: 21530510; the contents of which are herewith incorporated by reference.

As to polypeptides that may be detected in accordance with the present invention, gene products of all genes mentioned herein may be used as targets. Correspondingly, it is contemplated that such polypeptides could be used for species identification, typing and/or detection of drug resistance.

In certain example embodiments, the systems, devices, and methods, disclosed herein are directed to detecting the presence of one or more mosquito-borne parasite in a sample, such as a biological sample obtained from a subject. In certain example embodiments, the parasite may be selected from the species *Plasmodium falciparum, Plasmodium vivax, Plasmodium ovale, Plasmodium malariae* or *Plasmodium knowlesi*. Accordingly, the methods disclosed herein can be adapted for use in other methods (or in combination) with other methods that require quick identification of parasite species, monitoring the presence of parasites and parasite forms (for example corresponding to various stages of infection and parasite life-cycle, such as exo-erythrocytic cycle, erythrocytic cycle, sporpogonic cycle; parasite forms include merozoites, sporozoites, schizonts, gametocytes); detection of certain phenotypes (e.g., pathogen drug resistance), monitoring of disease progression and/or outbreak, and treatment (drug) screening. Further, in the case of malaria, a long time may elapse following the infective bite, namely a long incubation period, during which the patient does not show symptoms. Similarly, prophylactic treatments can delay the appearance of symptoms, and long asymptomatic periods can also be observed before a relapse. Such delays can easily cause misdiagnosis or delayed diagnosis, and thus impair the effectiveness of treatment.

Because of the rapid and sensitive diagnostic capabilities of the embodiments disclosed here, detection of parasite type, down to a single nucleotide difference, and the ability to be deployed as a POC device, the embodiments disclosed herein may be used guide therapeutic regimens, such as selection of the appropriate course of treatment. The embodiments disclosed herein may also be used to screen environmental samples (mosquito population, etc.) for the presence and the typing of the parasite. The embodiments may also be modified to detect mosquito-borne parasites and other mosquito-borne pathogens simultaneously. In some instances, malaria and other mosquito-borne pathogens may present initially with similar symptoms. Thus, the ability to quickly distinguish the type of infection can guide important treatment decisions. Other mosquito-borne pathogens that may be detected in conjunction with malaria include Dengue, West Nile virus, chikungunya, yellow fever, filariasis, Japanese encephalitis, Saint Louis encephalitis, western equine encephalitis, eastern equine encephalitis, Venezuelan equine encephalitis, La Crosse encephalitis, and Zika.

In certain example embodiments, the devices, systems, and methods disclosed herein may be used to distinguish multiple mosquito-borne parasite species in a sample. In certain example embodiments, identification may be based on ribosomal RNA sequences, including the 18S, 16S, 23S, and 5S subunits. In certain example embodiments, identification may be based on sequences of genes that are present in multiple copies in the genome, such as mitochondrial genes like CYTB. In certain example embodiments, identification may be based on sequences of genes that are highly expressed and/or highly conserved such as GAPDH, Histone H2B, enolase, or LDH. Methods for identifying relevant rRNA sequences are disclosed in U.S. Patent Application Publication No. 2017/0029872. In certain example embodiments, a set of guide RNA may be designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that uniquely variable across species or a subset of species such as the RecA gene family, RNA polymerase R subunit, may be used as well. Other suitable phylogenetic markers, and methods for identifying the same, are discussed for example in Wu et al. arXiv: 1307.8690 [q-bio.GN].

In certain example embodiments, species identification can be performed based on genes that are present in multiple copies in the genome, such as mitochondrial genes like CYTB. In certain example embodiments, species identification can be performed based on highly expressed and/or highly conserved genes such as GAPDH, Histone H2B, enolase, or LDH.

In certain example embodiments, a method or diagnostic is designed to screen mosquito-borne parasites across multiple phylogenetic and/or phenotypic levels at the same time. For example, the method or diagnostic may comprise the use of multiple CRISPR systems with different guide RNAs. A first set of guide RNAs may distinguish, for example, between *Plasmodium falciparum* or *Plasmodium vivax*. These general classes can be even further subdivided. For example, guide RNAs could be designed and used in the method or diagnostic that distinguish drug-resistant strains, in general or with respect to a specific drug or combination of drugs. A second set of guide RNA can be designed to distinguish microbes at the species level. Thus, a matrix may be produced identifying all mosquito-borne parasites species or subspecies, further divided according to drug resistance. The foregoing is for example purposes only. Other means for classifying other types of mosquito-borne parasites are also contemplated and would follow the general structure described above.

In certain example embodiments, the devices, systems and methods disclosed herein may be used to screen for mosquito-borne parasite genes of interest, for example drug resistance genes. Guide RNAs may be designed to distinguish between known genes of interest. Samples, including clinical samples, may then be screened using the embodiments disclosed herein for detection of one or more such genes. The ability to screen for drug resistance at POC would have tremendous benefit in selecting an appropriate treatment regime. In certain example embodiments, the drug resistance genes are genes encoding proteins such as transporter proteins, such as protein from drug/metabolite transporter family, the ATP-binding cassette (ABC) protein involved in substrate translocation, such as the ABC transporter C subfamily or the Na+/H+ exchanger; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase. In certain example embodiments, the drug resistance genes are selected from the *P. falciparum* chloroquine resistance transporter gene (pfcrt), the *P. falciparum* multidrug resistance transporter 1 (pfmdr1), the *P. falciparum* multidrug resistance-associated protein gene (Pfmrp), the *P. falciparum* Na+/H+ exchanger gene (pfnhe), the *P. falciparum* Ca2+ transporting ATPase 6 (pfatp6), the *P. falciparum* dihydropteroate synthase (pfdhps), dihydrofolate reductase activity (pfdhpr) and dihydrofolate reductase-thymidylate synthase (pfdhfr) genes, the cytochrome b gene, gtp cyclohydrolase and the Kelch13 (K13) gene as well as their functional heterologous genes in other *Plasmodium* species. Other identified drug-resistance markers are known in the art, for example as described in "Susceptibility of *Plasmodium falciparum* to antimalarial drugs (1996-2004)"; WHO; Artemisinin and artemisinin-based combination therapy resistance (April 2016 WHO/HTM/GMP/2016.5); "Drug-resistant malaria: molecular mechanisms and implications for public health" FEBS Lett. 2011 Jun. 6; 585(11):1551-62. doi:10.1016/j.febslet.2011.04.042. Epub 2011 Apr. 23. Review. PubMed PMID: 21530510; the contents of which are herewith incorporated by reference.

In some embodiments, a CRISPR system, detection system or methods of use thereof as described herein may be used to determine the evolution of a mosquito-borne parasite outbreak. The method may comprise detecting one or more target sequences from a plurality of samples from one or more subjects, wherein the target sequence is a sequence from a mosquito-borne parasite spreading or causing the outbreaks. Such a method may further comprise determining a pattern of mosquito-borne parasite transmission, or a mechanism involved in a disease outbreak caused by a mosquito-borne parasite. The samples may be derived from one or more humans, and/or be derived from one or more mosquitoes.

The pattern of pathogen transmission may comprise continued new transmissions from the natural reservoir of the mosquito-borne parasite or other transmissions (e.g., across mosquitoes) following a single transmission from the natural reservoir or a mixture of both. In one embodiment, the target sequence is preferably a sequence within the mosquito-borne parasite genome or fragments thereof. In one embodiment, the pattern of the mosquito-borne parasite transmission is the early pattern of the mosquito-borne parasite transmission, i.e., at the beginning of the mosquito-borne parasite outbreak. Determining the pattern of the mosquito-borne parasite transmission at the beginning of the outbreak increases likelihood of stopping the outbreak at the earliest possible time thereby reducing the possibility of local and international dissemination.

Determining the pattern of the mosquito-borne parasite transmission may comprise detecting a mosquito-borne parasite sequence according to the methods described herein. Determining the pattern of the pathogen transmission may further comprise detecting shared intra-host variations of the mosquito-borne parasite sequence between the subjects and determining whether the shared intra-host variations show temporal patterns. Patterns in observed intra-host and interhost variation provide important insight about transmission and epidemiology (Gire, et al., 2014).

In addition to other sample types disclosed herein, the sample may be derived from one or more mosquitoes, for example, the sample may comprise mosquito saliva.

Biomarker Detection

In certain example embodiments, the systems, devices, and methods disclosed herein may be used for biomarker detection. For example, the systems, devices and method disclosed herein may be used for SNP detection and/or genotyping. The systems, devices and methods disclosed herein may be also used for the detection of any disease state or disorder characterized by aberrant gene expression. Aberrant gene expression includes aberration in the gene expressed, location of expression and level of expression. Multiple transcripts or protein markers related to cardiovascular, immune disorders, and cancer among other diseases may be detected. In certain example embodiments, the embodiments disclosed herein may be used for cell free DNA detection of diseases that involve lysis, such as liver fibrosis and restrictive/obstructive lung disease. In certain example embodiments, the embodiments could be utilized for faster and more portable detection for pre-natal testing of cell-free DNA. The embodiments disclosed herein may be used for screening panels of different SNPs associated with, among others, cardiovascular health, lipid/metabolic signatures, ethnicity identification, paternity matching, human ID (e.g., matching suspect to a criminal database of SNP signatures). The embodiments disclosed herein may also be used for cell free DNA detection of mutations related to and released from cancer tumors. The embodiments disclosed herein may also be used for detection of meat quality, for example, by providing rapid detection of different animal sources in a given meat product. Embodiments disclosed herein may also be used for the detection of GMOs or gene editing related to DNA. As described herein elsewhere, closely related genotypes/alleles or biomarkers (e.g., having only a single nucleotide difference in a given target sequence) may be distinguished by introduction of a synthetic mismatch in the gRNA.

In an aspect, the invention relates to a method for detecting target nucleic acids in samples, comprising:
  distributing a sample or set of samples into one or more individual discrete volumes, the individual discrete volumes comprising a CRISPR system according to the invention as described herein;
  incubating the sample or set of samples under conditions sufficient to allow binding of the one or more guide RNAs to one or more target molecules;
  activating the CRISPR effector protein via binding of the one or more guide RNAs to the one or more target molecules, wherein activating the CRISPR effector protein results in modification of the RNA-based masking construct such that a detectable positive signal is generated; and
  detecting the detectable positive signal, wherein detection of the detectable positive signal indicates a presence of one or more target molecules in the sample.

Biomarker Sample Types

The sensitivity of the assays described herein are well suited for detection of target nucleic acids in a wide variety of biological sample types, including sample types in which the target nucleic acid is dilute or for which sample material is limited. Biomarker screening may be carried out on a number of sample types including, but not limited to, saliva, urine, blood, feces, sputum, and cerebrospinal fluid. The embodiments disclosed herein may also be used to detect up- and/or down-regulation of genes. For example, a sample may be serially diluted such that only over-expressed genes remain above the detection limit threshold of the assay.

In certain embodiments, the present invention provides steps of obtaining a sample of biological fluid (e.g., urine, blood plasma or serum, sputum, cerebral spinal fluid), and extracting the DNA. The mutant nucleotide sequence to be detected, may be a fraction of a larger molecule or can be present initially as a discrete molecule.

In certain embodiments, DNA is isolated from plasma/serum of a cancer patient. For comparison, DNA samples isolated from neoplastic tissue and a second sample may be isolated from non-neoplastic tissue from the same patient (control), for example, lymphocytes. The non-neoplastic tissue can be of the same type as the neoplastic tissue or from a different organ source. In certain embodiments, blood samples are collected, and plasma immediately separated from the blood cells by centrifugation. Serum may be filtered and stored frozen until DNA extraction.

In certain example embodiments, target nucleic acids are detected directly from a crude or unprocessed sample, such as blood, serum, saliva, cerebrospinal fluid, sputum, or urine. In certain example embodiments, the target nucleic acid is cell free DNA.

Circulating Tumor Cells

In one embodiment, circulating cells (e.g., circulating tumor cells (CTC)) can be assayed with the present invention. Isolation of circulating tumor cells (CTC) for use in any of the methods described herein may be performed. Exemplary technologies that achieve specific and sensitive detection and capture of circulating cells that may be used in the present invention have been described (Mostert B, et al., Circulating tumor cells (CTCs): detection methods and their clinical relevance in breast cancer. Cancer Treat Rev. 2009; 35:463-474; and Talasaz A H, et al., Isolating highly enriched populations of circulating epithelial cells and other rare cells from blood using a magnetic sweeper device. Proc Natl Acad Sci USA. 2009; 106:3970-3975). As few as one CTC may be found in the background of 105-106 peripheral blood mononuclear cells (Ross A A, et al., Detection and viability of tumor cells in peripheral blood stem cell collections from breast cancer patients using immunocytochemical and clonogenic assay techniques. Blood. 1993, 82:2605-2610). The CellSearch® platform uses immunomagnetic beads coated with antibodies to Epithelial Cell Adhesion Molecule (EpCAM) to enrich for EPCAM-expressing epithelial cells, followed by immunostaining to confirm the presence of cytokeratin staining and absence of the leukocyte marker CD45 to confirm that captured cells are epithelial tumor cells (Momburg F, et al., Immunohistochemical study of the expression of a Mr 34,000 human epithelium-specific surface glycoprotein in normal and malignant tissues. Cancer Res. 1987; 47:2883-2891; and Allard W J, et al., Tumor cells circulate in the peripheral blood of all major carcinomas but not in healthy subjects or patients with nonmalignant diseases. Clin Cancer Res. 2004; 10:6897-6904). The number of cells captured have been prospectively demonstrated to have prognostic significance for breast, colorectal and prostate cancer patients with advanced disease (Cohen S J, et al., J Clin Oncol. 2008; 26:3213-3221; Cristofanilli M, et al. N Engl J Med. 2004; 351:781-791; Cristofanilli M, et al., J Clin Oncol. 2005; 23: 1420-1430; and de Bono J S, et al. Clin Cancer Res. 2008; 14:6302-6309).

The present invention also provides for isolating CTCs with CTC-Chip Technology. CTC-Chip is a microfluidic based CTC capture device where blood flows through a chamber containing thousands of microposts coated with anti-EpCAM antibodies to which the CTCs bind (Nagrath S, et al. Isolation of rare circulating tumour cells in cancer patients by microchip technology. Nature. 2007; 450: 1235-1239). CTC-Chip provides a significant increase in CTC counts and purity in comparison to the CellSearch® system (Maheswaran S, et al. Detection of mutations in EGFR in circulating lung-cancer cells, N Engl J Med. 2008; 359:366-377), both platforms may be used for downstream molecular analysis.

Cell-Free Chromatin

In certain embodiments, cell free chromatin fragments are isolated and analyzed according to the present invention. Nucleosomes can be detected in the serum of healthy individuals (Stroun et al., Annals of the New York Academy of Sciences 906: 161-168 (2000)) as well as individuals afflicted with a disease state. Moreover, the serum concentration of nucleosomes is considerably higher in patients suffering from benign and malignant diseases, such as cancer and autoimmune disease (Holdenrieder et al (2001) Int J Cancer 95, 1 14-120, Trejo-Becerril et al (2003) Int J Cancer 104, 663-668; Kuroi et al 1999 Breast Cancer 6, 361-364; Kuroi et al (2001) Int j Oncology 19, 143-148; Amoura et al (1997) Arth Rheum 40, 2217-2225; Williams et al (2001) J Rheumatol 28, 81-94). Not being bound by a theory, the high concentration of nucleosomes in tumor bearing patients derives from apoptosis, which occurs spontaneously in proliferating tumors. Nucleosomes circulating in the blood contain uniquely modified histones. For example, U.S. Patent Publication No. 2005/0069931 (Mar. 31, 2005) relates to the use of antibodies directed against specific histone N-terminus modifications as diagnostic indicators of disease, employing such histone-specific antibodies to isolate nucleosomes from a blood or serum sample of a patient to facilitate purification and analysis of the accompanying DNA for diagnostic/screening purposes. Accordingly, the present invention may use chromatin bound DNA to detect and monitor, for example, tumor mutations. The identification of the DNA associated with modified histones can serve as diagnostic markers of disease and congenital defects.

Thus, in another embodiment, isolated chromatin fragments are derived from circulating chromatin, preferably circulating mono and oligonucleosomes. Isolated chromatin fragments may be derived from a biological sample. The biological sample may be from a subject or a patient in need thereof. The biological sample may be sera, plasma, lymph, blood, blood fractions, urine, synovial fluid, spinal fluid, saliva, circulating tumor cells or mucous.

Cell-Free DNA (cfDNA)

In certain embodiments, the present invention may be used to detect cell free DNA (cfDNA). Cell free DNA in plasma or serum may be used as a non-invasive diagnostic tool. For example, cell free fetal DNA has been studied and optimized for testing on-compatible RhD factors, sex determination for X-linked genetic disorders, testing for single gene disorders, identification of preeclampsia. For example, sequencing the fetal cell fraction of cfDNA in maternal plasma is a reliable approach for detecting copy number changes associated with fetal chromosome aneuploidy. For another example, cfDNA isolated from cancer patients has been used to detect mutations in key genes relevant for treatment decisions.

In certain example embodiments, the present disclosure provides detecting cfDNA directly from a patient sample. In certain other example embodiment, the present disclosure provides enriching cfDNA using the enrichment embodiments disclosed above and prior to detecting the target cfDNA.

Exosomes

In one embodiment, exosomes can be assayed with the present invention. Exosomes are small extracellular vesicles that have been shown to contain RNA. Isolation of exosomes by ultracentrifugation, filtration, chemical precipitation, size exclusion chromatography, and microfluidics are known in the art. In one embodiment exosomes are purified using an exosome biomarker. Isolation and purification of exosomes from biological samples may be performed by any known methods (see e.g., WO2016172598A1).

SNP Detection and Genotyping

In certain embodiments, the present invention may be used to detect the presence of single nucleotide polymorphisms (SNP) in a biological sample. The SNPs may be related to maternity testing (e.g., sex determination, fetal defects). They may be related to a criminal investigation. In one embodiment, a suspect in a criminal investigation may be identified by the present invention. Not being bound by a theory, nucleic acid based forensic evidence may require the most sensitive assay available to detect a suspect or victim's genetic material because the samples tested may be limiting.

In other embodiments, SNPs associated with a disease are encompassed by the present invention. SNPs associated with diseases are well known in the art and one skilled in the art can apply the methods of the present invention to design suitable guide RNAs (see e.g., ncbi.nlm.nih.gov/clinvar?term=human %5Borgn %5D).

In an aspect, the invention relates to a method for genotyping, such as SNP genotyping, comprising:
  distributing a sample or set of samples into one or more individual discrete volumes, the individual discrete volumes comprising a CRISPR system according to the invention as described herein;
  incubating the sample or set of samples under conditions sufficient to allow binding of the one or more guide RNAs to one or more target molecules;
  activating the CRISPR effector protein via binding of the one or more guide RNAs to the one or more target molecules, wherein activating the CRISPR effector protein results in modification of the RNA-based masking construct such that a detectable positive signal is generated; and
  detecting the detectable positive signal, wherein detection of the detectable positive signal indicates a presence of one or more target molecules characteristic for a particular genotype in the sample.

Figure 60:
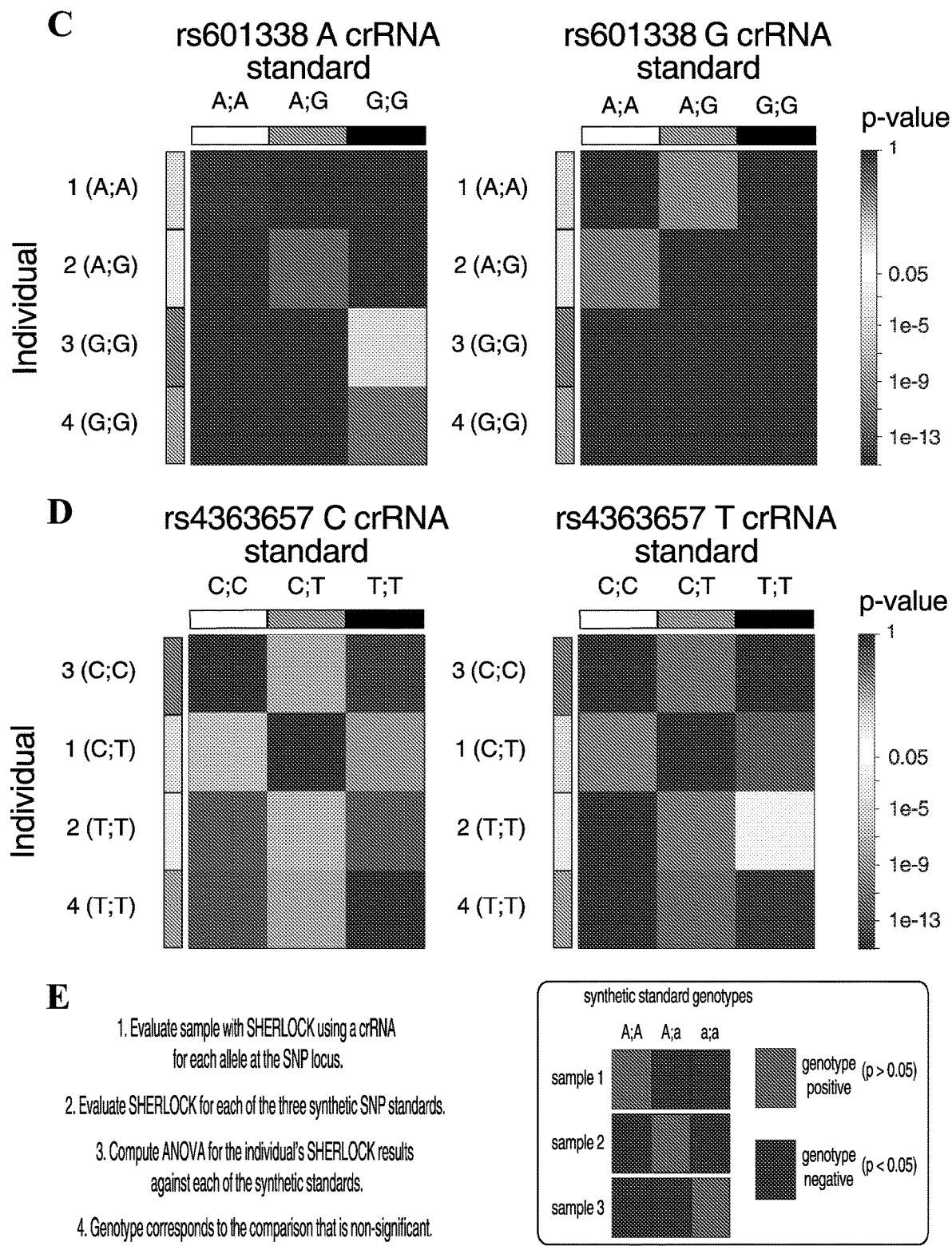
FIG. 60—Development of synthetic genotyping standards to accurately genotype human SNPs. (A) Genotyping with SHERLOCK at the rs601338 SNP site for each of the four individuals compared against PCR-amplified genotype standards. (n=4 technical replicates; bars represent mean±s.e.m.) (B) Genotyping with SHERLOCK at the rs4363657 SNP site for each of the four individuals compared against PCR-amplified genotype standards. (n=4 technical replicates; bars represent mean±s.e.m.) (C) Heatmaps of computed p-values between the SHERLOCK results for each individual and the synthetic standards at the rs601338 SNP site. A heatmap is shown for each of the allele-sensing crRNAs. The heatmap color map is scaled such that insignificance (p>0.05) is red and significance (p<0.05) is blue. (n=4 technical replicates, one-way ANOVA). (D) Heatmaps of computed p-values between the SHERLOCK results for each individual and the synthetic standards at the rs4363657 SNP site. A heatmap is shown for each of the allele-sensing crRNAs. The heatmap color map is scaled such that insignificance (p>0.05) is red and significance (p<0.05) is blue. (n=4 technical replicates, one-way ANOVA) (E) A guide for understanding the p-value heatmap results of SHERLOCK genotyping. Genotyping can easily be called by choosing the allele that corresponds to a p-value>0.05 between the individual and allelic synthetic standards. Red blocks correspond to non-significant differences between the synthetic standard and individual's SHERLOCK result and thus a genotype-positive result. Blue blocks correspond to significant differences between the synthetic standard and individual's SHERLOCK result and thus a genotype-negative result.

In certain embodiments, the detectable signal is compared to (e.g., by comparison of signal intensity) one or more standard signal, preferably a synthetic standard signal, such as for instance illustrated in an embodiment in FIG. 60. In certain embodiments, the standard is or corresponds to a particular genotype. In certain embodiments, the standard comprises a particular SNP or other (single) nucleotide variation. In certain embodiments, the standard is a (PCR-amplified) genotype standard. In certain embodiments, the standard is or comprises DNA. In certain embodiments, the standard is or comprises RNA. In certain embodiments, the standard is or comprised RNA which is transcribed from DNA. In certain embodiments, the standard is or comprises DNA which is reverse transcribed from RNA. In certain embodiments, the detectable signal is compared to one or more standard, each of which corresponds to a known genotype, such as a SNP or other (single) nucleotide variation. In certain embodiments, the detectable signal is compared to one or more standard signal and the comparison comprises statistical analysis, such as by parametric or non-parametric statistical analysis, such as by one- or two-way ANOVA, etc. In certain embodiments, the detectable signal is compared to one or more standard signal and when the detectable signal does not (statistically) significantly deviate from the standard, the genotype is determined as the genotype corresponding to said standard.

In other embodiments, the present invention allows rapid genotyping for emergency pharmacogenomics. In one embodiment, a single point of care assay may be used to genotype a patient brought into the emergency room. The patient may be suspected of having a blood clot and an emergency physician needs to decide a dosage of blood thinner to administer. In exemplary embodiments, the present invention may provide guidance for administration of blood thinners during myocardial infarction or stroke treatment based on genotyping of markers such as VKORC1, CYP2C9, and CYP2C19. In one embodiment, the blood thinner is the anticoagulant warfarin (Holford, N H (December 1986). "Clinical Pharmacokinetics and Pharmacodynamics of Warfarin Understanding the Dose-Effect Relationship". Clinical Pharmacokinetics. Springer International Publishing. 11 (6): 483-504). Genes associated with blood clotting are known in the art (see e.g., US20060166239A1; Litin S C, Gastineau D A (1995) "Current concepts in anticoagulant therapy". Mayo Clin. Proc. 70 (3): 266-72; and Rusdiana et al., Responsiveness to low-dose warfarin associated with genetic variants of VKORC1, CYP2C9, CYP2C19, and CYP4F2 in an Indonesian population. Eur J Clin Pharmacol. 2013 March; 69(3):395-405). Specifically, in the VKORC1 1639 (or 3673) single-nucleotide polymorphism, the common ("wild-type") G allele is replaced by the A allele. People with an A allele (or the "A haplotype") produce less VKORC1 than do those with the G allele (or the "non-A haplotype"). The prevalence of these variants also varies by race, with 37% of Caucasians and 14% of Africans carrying the A allele. The end result is a decreased number of clotting factors and therefore, a decreased ability to clot.

In certain example embodiments, the availability of genetic material for detecting a SNP in a patient allows for detecting SNPs without amplification of a DNA or RNA sample. In the case of genotyping, the biological sample tested is easily obtained. In certain example embodiments, the incubation time of the present invention may be shortened. The assay may be performed in a period of time required for an enzymatic reaction to occur. One skilled in the art can perform biochemical reactions in 5 minutes (e.g., 5-minute ligation). The present invention may use an automated DNA extraction device to obtain DNA from blood. The DNA can then be added to a reaction that generates a target molecule for the effector protein. Immediately upon generating the target molecule the masking agent can be cut and a signal detected. In exemplary embodiments, the present invention allows a POC rapid diagnostic for determining a genotype before administering a drug (e.g., blood thinner). In the case where an amplification step is used, all of the reactions occur in the same reaction in a one step process. In preferred embodiments, the POC assay may be performed in less than an hour, preferably 10 minutes, 20 minutes, 30 minutes, 40 minutes, or 50 minutes.

In certain embodiments, the systems, devices, and methods disclosed herein may be used for detecting the presence or expression level of long non-coding RNAs (lncRNAs). Expression of certain lncRNAs is associated with disease state and/or drug resistance. In particular, certain lncRNAs (e.g., TCONS_00011252, NR_034078, TCONS_00010506, TCONS_00026344, TCONS_00015940, TCONS_00028298, TCONS_00026380, TCONS_0009861, TCONS_00026521, TCONS_00016127, NR_125939, NR_033834, TCONS_00021026, TCONS_00006579, NR_109890, and NR_026873) are associated with resistance to cancer treatment, such as resistance to one or more BRAF inhibitors (e.g., Vemurafenib, Dabrafenib, Sorafenib, GDC-0879, PLX-4720, and LGX818) for treating melanoma (e.g., nodular melanoma, lentigo maligna, lentigo maligna melanoma, acral lentiginous melanoma, superficial spreading melanoma, mucosal melanoma, polypoid melanoma, desmoplastic melanoma, amelanotic melanoma, and soft-tissue melanoma). The detection of lncRNAs using the various embodiments described herein can facilitate disease diagnosis and/or selection of treatment options.

In one embodiment, the present invention can guide DNA- or RNA-targeted therapies (e.g., CRISPR, TALE, Zinc finger proteins, RNAi), particularly in settings where rapid administration of therapy is important to treatment outcomes.

LOH Detection

Cancer cells undergo a loss of genetic material (DNA) when compared to normal cells. This deletion of genetic material which almost all, if not all, cancers undergo is referred to as "loss of heterozygosity" (LOH). Loss of heterozygosity (LOH) is a gross chromosomal event that results in loss of the entire gene and the surrounding chromosomal region. The loss of heterozygosity is a common occurrence in cancer, where it can indicate the absence of a functional tumor suppressor gene in the lost region. However, a loss may be silent because there still is one functional gene left on the other chromosome of the chromosome pair. The remaining copy of the tumor suppressor gene can be inactivated by a point mutation, leading to loss of a tumor suppressor gene. The loss of genetic material from cancer cells can result in the selective loss of one of two or more alleles of a gene vital for cell viability or cell growth at a particular locus on the chromosome.

An "LOH marker" is DNA from a microsatellite locus, a deletion, alteration, or amplification in which, when compared to normal cells, is associated with cancer or other diseases. An LOH marker often is associated with loss of a tumor suppressor gene or another, usually tumor related, gene.

The term "microsatellites" refers to short repetitive sequences of DNA that are widely distributed in the human genome. A microsatellite is a tract of tandemly repeated (i.e., adjacent) DNA motifs that range in length from two to five nucleotides and are typically repeated 5-50 times. For example, the sequence TATATATATA (SEQ ID NO: 418) is a dinucleotide microsatellite, and GTCGTCGTCGTCGTC (SEQ ID NO: 419) is a trinucleotide microsatellite (with A being Adenine, G Guanine, C Cytosine, and T Thymine). Somatic alterations in the repeat length of such microsatellites have been shown to represent a characteristic feature of tumors. Guide RNAs may be designed to detect such microsatellites. Furthermore, the present invention may be used to detect alterations in repeat length, as well as amplifications and deletions based upon quantitation of the detectable signal. Certain microsatellites are located in regulatory flanking or intronic regions of genes, or directly in codons of genes. Microsatellite mutations in such cases can lead to phenotypic changes and diseases, notably in triplet expansion diseases such as fragile X syndrome and Huntington's disease.

Frequent loss of heterozygosity (LOH) on specific chromosomal regions has been reported in many kinds of malignancies. Allelic losses on specific chromosomal regions are the most common genetic alterations observed in a variety of malignancies, thus microsatellite analysis has been applied to detect DNA of cancer cells in specimens from body fluids, such as sputum for lung cancer and urine for bladder cancer. (Rouleau, et al. Nature 363, 515-521 (1993); and Latif, et al. Science 260, 1317-1320 (1993)). Moreover, it has been established that markedly increased concentrations of soluble DNA are present in plasma of individuals with cancer and some other diseases, indicating that cell free serum or plasma can be used for detecting cancer DNA with microsatellite abnormalities. (Kamp, et al. Science 264, 436-440 (1994); and Steck, et al. Nat Genet. 15(4), 356-362 (1997)). Two groups have reported microsatellite alterations in plasma or serum of a limited number of patients with small cell lung cancer or head and neck cancer. (Hahn, et al. Science 271, 350-353 (1996) and Miozzo, et al. Cancer Res. 56, 2285-2288 (1996)). Detection of loss of heterozygosity in tumors and serum of melanoma patients has also been previously shown (see, e.g., United States patent number U.S. Pat. No. 6,465,177B1).

Thus, it is advantageous to detect of LOH markers in a subject suffering from or at risk of cancer. The present invention may be used to detect LOH in tumor cells. In one embodiment, circulating tumor cells may be used as a biological sample. In preferred embodiments, cell free DNA obtained from serum or plasma is used to noninvasively detect and/or monitor LOH. In other embodiments, the biological sample may be any sample described herein (e.g., a urine sample for bladder cancer). Not being bound by a theory, the present invention may be used to detect LOH markers with improved sensitivity as compared to any prior method, thus providing early detection of mutational events. In one embodiment, LOH is detected in biological fluids, wherein the presence of LOH is associated with the occurrence of cancer. The method and systems described herein represents a significant advance over prior techniques, such as PCR or tissue biopsy by providing a non-invasive, rapid, and accurate method for detecting LOH of specific alleles associated with cancer. Thus, the present invention provides a methods and systems which can be used to screen high-risk populations and to monitor high risk patients undergoing chemoprevention, chemotherapy, immunotherapy or other treatments.

Because the method of the present invention requires only DNA extraction from bodily fluid such as blood, it can be performed at any time and repeatedly on a single patient. Blood can be taken and monitored for LOH before or after surgery; before, during, and after treatment, such as chemotherapy, radiation therapy, gene therapy or immunotherapy; or during follow-up examination after treatment for disease progression, stability, or recurrence. Not being bound by a theory, the method of the present invention also may be used to detect subclinical disease presence or recurrence with an LOH marker specific for that patient since LOH markers are specific to an individual patient's tumor. The method also can detect if multiple metastases may be present using tumor specific LOH markers.

Detection of Epigenetic Modifications

Histone variants, DNA modifications, and histone modifications indicative of cancer or cancer progression may be used in the present invention. For example, U.S. patent publication 20140206014 describes that cancer samples had elevated nucleosome H2AZ, macroH2A1.1, 5-methylcytosine, P-H2AX(Ser139) levels as compared to healthy subjects. The presence of cancer cells in an individual may generate a higher level of cell free nucleosomes in the blood as a result of the increased apoptosis of the cancer cells. In one embodiment, an antibody directed against marks associated with apoptosis, such as H2B Ser 14(P), may be used to identify single nucleosomes that have been released from apoptotic neoplastic cells. Thus, DNA arising from tumor cells may be advantageously analyzed according to the present invention with high sensitivity and accuracy.

Pre-Natal Screening

In certain embodiments, the method and systems of the present invention may be used in prenatal screening. In certain embodiments, cell-free DNA is used in a method of prenatal screening. In certain embodiments, DNA associated with single nucleosomes or oligonucleosomes may be detected with the present invention. In preferred embodiments, detection of DNA associated with single nucleosomes or oligonucleosomes is used for prenatal screening. In certain embodiments, cell-free chromatin fragments are used in a method of prenatal screening.

Prenatal diagnosis or prenatal screening refers to testing for diseases or conditions in a fetus or embryo before it is born. The aim is to detect birth defects such as neural tube defects, Down syndrome, chromosome abnormalities, genetic disorders and other conditions, such as spina bifida, cleft palate, Tay Sachs disease, sickle cell anemia, thalassemia, cystic fibrosis, Muscular dystrophy, and fragile X syndrome. Screening can also be used for prenatal sex discernment. Common testing procedures include amniocentesis, ultrasonography including nuchal translucency ultrasound, serum marker testing, or genetic screening. In some cases, the tests are administered to determine if the fetus will be aborted, though physicians and patients also find it useful to diagnose high-risk pregnancies early so that delivery can be scheduled in a tertian, care hospital where the baby can receive appropriate care.

It has been realized that there are fetal cells which are present in the mother's blood, and that these cells present a potential source of fetal chromosomes for prenatal DNA-based diagnostics. Additionally, fetal DNA ranges from about 2-10% of the total DNA in maternal blood. Currently available prenatal genetic tests usually involve invasive procedures. For example, chorionic villus sampling (CVS) performed on a pregnant woman around 10-12 weeks into the pregnancy and amniocentesis performed at around 14-16 weeks all contain invasive procedures to obtain the sample for testing chromosomal abnormalities in a fetus. Fetal cells obtained via these sampling procedures are usually tested for chromosomal abnormalities using cytogenetic or fluorescent in situ hybridization (FISH) analyses. Cell-free fetal DNA has been shown to exist in plasma and serum of pregnant women as early as the sixth week of gestation, with concentrations rising during pregnancy and peaking prior to parturition. Because these cells appear very early in the pregnancy, they could form the basis of an accurate, non-invasive, first trimester test. Not being bound by a theory, the present invention provides unprecedented sensitivity in detecting low amounts of fetal DNA. Not being bound by a theory, abundant amounts of maternal DNA is generally concomitantly recovered along with the fetal DNA of interest, thus decreasing sensitivity in fetal DNA quantification and mutation detection. The present invention overcomes such problems by the unexpectedly high sensitivity of the assay.

The H3 class of histones consists of four different protein types: the main types, H3.1 and H3.2; the replacement type, H3.3; and the testis specific variant, H3t. Although H3.1 and H3.2 are closely related, only differing at Ser96, H3.1 differs from H3.3 in at least 5 amino acid positions. Further, H3.1 is highly enriched in fetal liver, in comparison to its presence in adult tissues including liver, kidney and heart. In adult human tissue, the H3.3 variant is more abundant than the H3.1 variant, whereas the converse is true for fetal liver. The present invention may use these differences to detect fetal nucleosomes and fetal nucleic acid in a maternal biological sample that comprises both fetal and maternal cells and/or fetal nucleic acid.

In one embodiment, fetal nucleosomes may be obtained from blood. In other embodiments, fetal nucleosomes are obtained from a cervical mucus sample. In certain embodiments, a cervical mucus sample is obtained by swabbing or lavage from a pregnant woman early in the second trimester or late in the first trimester of pregnancy. The sample may be placed in an incubator to release DNA trapped in mucus. The incubator may be set at 37° C. The sample may be rocked for approximately 15 to 30 minutes. Mucus may be further dissolved with a mucinase for the purpose of releasing DNA. The sample may also be subjected to conditions, such as chemical treatment and the like, as well known in the art, to induce apoptosis to release fetal nucleosomes. Thus, a cervical mucus sample may be treated with an agent that induces apoptosis, whereby fetal nucleosomes are released. Regarding enrichment of circulating fetal DNA, reference is made to U.S. patent publication Nos. 20070243549 and 20100240054. The present invention is especially advantageous when applying the methods and systems to prenatal screening where only a small fraction of nucleosomes or DNA may be fetal in origin.

Prenatal screening according to the present invention may be for a disease including, but not limited to Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, *Porphyria*, Fragile-X-Syndrome, Robertsonian translocation, Angelman syndrome, DiGeorge syndrome and Wolf-Hirschhorn Syndrome.

Several further aspects of the invention relate to diagnosing, prognosing and/or treating defects associated with a wide range of genetic diseases which are further described on the website of the National Institutes of Health under the topic subsection Genetic Disorders (website at health.nih.gov/topic/Genetic Disorders).

Cancer and Cancer Drug Resistance Detection

In certain embodiments, the present invention may be used to detect genes and mutations associated with cancer. In certain embodiments, mutations associated with resistance are detected. The amplification of resistant tumor cells or appearance of resistant mutations in clonal populations of tumor cells may arise during treatment (see, e.g., Burger J A, et al., Clonal evolution in patients with chronic lymphocytic leukaemia developing resistance to BTK inhibition. Nat Commun. 2016 May 20; 7:11589; Landau D A, et al., Mutations driving CLL and their evolution in progression and relapse. Nature. 2015 Oct. 22; 526(7574):525-30; Landau D A, et al., Clonal evolution in hematological malignancies and therapeutic implications. Leukemia. 2014 January; 28(1):34-43; and Landau D A, et al., Evolution and impact of subclonal mutations in chronic lymphocytic leukemia. Cell. 2013 Feb. 14; 152(4):714-26). Accordingly, detecting such mutations requires highly sensitive assays and monitoring requires repeated biopsy. Repeated biopsies are inconvenient, invasive and costly. Resistant mutations can be difficult to detect in a blood sample or other noninvasively collected biological sample (e.g., blood, saliva, urine) using the prior methods known in the art. Resistant mutations may refer to mutations associated with resistance to a chemotherapy, targeted therapy, or immunotherapy.

In certain embodiments, mutations occur in individual cancers that may be used to detect cancer progression. In one embodiment, mutations related to T cell cytolytic activity against tumors have been characterized and may be detected by the present invention (see e.g., Rooney et al., Molecular and genetic properties of tumors associated with local immune cytolytic activity, Cell. 2015 January 15; 160(1-2): 48-61). Personalized therapies may be developed for a patient based on detection of these mutations (see e.g., WO2016100975A1). In certain embodiments, cancer specific mutations associated with cytolytic activity may be a mutation in a gene selected from the group consisting of CASP8, B2M, PIK3CA, SMC1A, ARID5B, TET2, ALPK2, COL5A1, TP53, DNER, NCOR1, MORC4, CIC, IRF6, MYOCD, ANKLE1, CNKSR1, NF1, SOS1, ARID2, CUL4B, DDX3X, FUBP1, TCP11L2, HLA-A, B or C, CSNK2A1, MET, ASXL1, PD-L1, PD-L2, IDO1, IDO2, ALOX12B and ALOX15B, or copy number gain, excluding whole-chromosome events, impacting any of the following chromosomal bands: 6916.1-q21, 6q22.31-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p13.2, 17p13.1 (containing ALOX12B, ALOX15B), and 22q11.1-q11.21.

In certain embodiments, the present invention is used to detect a cancer mutation (e.g., resistance mutation) during the course of a treatment and after treatment is completed. The sensitivity of the present invention may allow for noninvasive detection of clonal mutations arising during treatment and can be used to detect a recurrence in the disease.

In certain example embodiments, detection of microRNAs (miRNA) and/or miRNA signatures of differentially expressed miRNA, may be used to detect or monitor progression of a cancer and/or detect drug resistance to a cancer therapy. As an example, Nadal et al. (Nature Scientific Reports, (2015) doi:10.1038/srep12464) describe mRNA signatures that may be used to detect non-small cell lung cancer (NSCLC).

In certain example embodiments, the presence of resistance mutations in clonal subpopulations of cells may be used in determining a treatment regimen. In other embodiments, personalized therapies for treating a patient may be administered based on common tumor mutations. In certain embodiments, common mutations arise in response to treatment and lead to drug resistance. In certain embodiments, the present invention may be used in monitoring patients for cells acquiring a mutation or amplification of cells harboring such drug resistant mutations.

Treatment with various chemotherapeutic agents, particularly with targeted therapies such as tyrosine kinase inhibitors, frequently leads to new mutations in the target molecules that resist the activity of the therapeutic. Multiple strategies to overcome this resistance are being evaluated, including development of second-generation therapies that are not affected by these mutations and treatment with multiple agents including those that act downstream of the resistance mutation. In an exemplary embodiment, a common mutation to ibrutinib, a molecule targeting Bruton's Tyrosine Kinase (BTK) and used for CLL and certain lymphomas, is a Cysteine to Serine change at position 481 (BTK/C481S). Erlotinib, which targets the tyrosine kinase domain of the Epidermal Growth Factor Receptor (EGFR), is commonly used in the treatment of lung cancer and resistant tumors invariably develop following therapy. A common mutation found in resistant clones is a threonine to methionine mutation at position 790.

Non-silent mutations shared between populations of cancer patients and common resistant mutations that may be detected with the present invention are known in the art (see e.g., WO/2016/187508). In certain embodiments, drug resistance mutations may be induced by treatment with ibrutinib, erlotinib, imatinib, gefitinib, crizotinib, trastuzumab, vemurafenib, RAF/MEK, check point blockade therapy, or anti-estrogen therapy. In certain embodiments, the cancer specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT 1, BRAF, MEK1, MEK2, NRAS, RAC1, and ESR1.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Recently, gene expression in tumors and their microenvironments have been characterized at the single cell level (see e.g., Tirosh, et al. Dissecting the multicellular ecosystem of metastatic melanoma by single cell RNA-seq. Science 352, 189-196, doi:10.1126/science.aad0501 (2016)); Tirosh et al., Single-cell RNA-seq supports a developmental hierarchy in human oligodendroglioma. Nature. 2016 Nov. 10; 539(7628):309-313. doi: 10.1038/nature20123. Epub 2016 Nov. 2; and International Patent Publication Number WO 2017004153 A1). In certain embodiments, gene signatures may be detected using the present invention. In one embodiment complement genes are monitored or detected in a tumor microenvironment. In one embodiment MITF and AXL programs are monitored or detected. In one embodiment, a tumor specific stem cell or progenitor cell signature is detected. Such signatures indicate the state of an immune response and state of a tumor. In certain embodiments, the state of a tumor in terms of proliferation, resistance to treatment and abundance of immune cells may be detected.

Thus, in certain embodiments, the invention provides low-cost, rapid, multiplexed cancer detection panels for circulating DNA, such as tumor DNA, particularly for monitoring disease recurrence or the development of common resistance mutations.

Immunotherapy Applications

The embodiments disclosed herein can also be useful in further immunotherapy contexts. For instance, in some embodiments, methods of diagnosing, prognosing and/or staging an immune response in a subject comprise detecting a first level of expression, activity and/or function of one or more biomarker and comparing the detected level to a control level wherein a difference in the detected level and the control level indicates that the presence of an immune response in the subject.

In certain embodiments, the present invention may be used to determine dysfunction or activation of tumor infiltrating lymphocytes (TIL). TILs may be isolated from a tumor using known methods. The TILs may be analyzed to determine whether they should be used in adoptive cell transfer therapies. Additionally, chimeric antigen receptor T cells (CAR T cells) may be analyzed for a signature of dysfunction or activation before administering them to a subject. Exemplary signatures for dysfunctional and activated T cell have been described (see e.g., Singer M, et al., A Distinct Gene Module for Dysfunction Uncoupled from Activation in Tumor-Infiltrating T Cells. Cell. 2016 Sep. 8; 166(6):1500-1511.e9. doi: 10.1016/j.cell.2016.08.052).

In some embodiments, C2c2 is used to evaluate that state of immune cells, such as T cells (e.g., CD8+ and/or CD4+ T cells). In particular, T cell activation and/or dysfunction can be determined, e.g., based on genes or gene signatures associated with one or more of the T cell states. In this way, c2c2 can be used to determine the presence of one or more subpopulations of T cells.

In some embodiments, C2c2 can be used in a diagnostic assay or may be used as a method of determining whether a patient is suitable for administering an immunotherapy or another type of therapy. For example, detection of gene or biomarker signatures may be performed via c2c2 to determine whether a patient is responding to a given treatment or, if the patient is not responding, if this may be due to T cell dysfunction. Such detection is informative regarding the types of therapy the patient is best suited to receive. For example, whether the patient should receive immunotherapy.

In some embodiments, the systems and assays disclosed herein may allow clinicians to identify whether a patient's response to a therapy (e.g., an adoptive cell transfer (ACT) therapy) is due to cell dysfunction, and if it is, levels of up-regulation and down-regulation across the biomarker signature will allow problems to be addressed. For example, if a patient receiving ACT is non-responsive, the cells administered as part of the ACT may be assayed by an assay disclosed herein to determine the relative level of expression of a biomarker signature known to be associated with cell activation and/or dysfunction states. If a particular inhibitory receptor or molecule is up-regulated in the ACT cells, the patient may be treated with an inhibitor of that receptor or molecule. If a particular stimulatory receptor or molecule is down-regulated in the ACT cells, the patient may be treated with an agonist of that receptor or molecule.

In certain example embodiments, the systems, methods, and devices described herein may be used to screen gene signatures that identify a particular cell type, cell phenotype, or cell state. Likewise, through the use of such methods as compressed sensing, the embodiments disclosed herein may be used to detect transcriptomes. Gene expression data are highly structured, such that the expression level of some genes is predictive of the expression level of others. Knowledge that gene expression data are highly structured allows for the assumption that the number of degrees of freedom in the system are small, which allows for assuming that the basis for computation of the relative gene abundances is sparse. It is possible to make several biologically motivated assumptions that allow Applicants to recover the nonlinear interaction terms while under-sampling, without having any specific knowledge of which genes are likely to interact. In particular, if Applicants assume that genetic interactions are low rank, sparse, or a combination of these, then the true number of degrees of freedom is small relative to the complete combinatorial expansion, which enables Applicants to infer the full nonlinear landscape with a relatively small number of perturbations. Working around these assumptions, analytical theories of matrix completion and compressed sensing may be used to design under-sampled combinatorial perturbation experiments. In addition, a kernel-learning framework may be used to employ under-sampling by building predictive functions of combinatorial perturbations without directly learning any individual interaction coefficient Compresses sensing provides a way to identify the minimal number of target transcripts to be detected in order obtain a comprehensive gene-expression profile. Methods for compressed sensing are disclosed in PCT/US2016/059230 "Systems and Methods for Determining Relative Abundances of Biomolecules" filed Oct. 27, 2016, which is incorporated herein by reference. Having used methods like compressed sensing to identify a minimal transcript target set, a set of corresponding guide RNAs may then be designed to detect said transcripts. Accordingly, in certain example embodiments, a method for obtaining a gene-expression profile of cell comprises detecting, using the embodiments disclosed, herein a minimal transcript set that provides a gene-expression profile of a cell or population of cells.

Detecting Nucleic Acid Tagged Items

Alternatively, the embodiments described herein may be used to detect nucleic acid identifiers. Nucleic acid identifiers are non-coding nucleic acids that may be used to identify a particular article. Example nucleic acid identifiers, such as DNA watermarks, are described in Heider and Barnekow. "DNA watermarks: A proof of concept" BMC Molecular Biology 9:40 (2008). The nucleic acid identifiers may also be a nucleic acid barcode. A nucleic-acid based barcode is a short sequence of nucleotides (for example, DNA, RNA, or combinations thereof) that is used as an identifier for an associated molecule, such as a target molecule and/or target nucleic acid. A nucleic acid barcode can have a length of at least, for example, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or 100 nucleotides, and can be in single- or double-stranded form. One or more nucleic acid barcodes can be attached, or "tagged," to a target molecule and/or target nucleic acid. This attachment can be direct (for example, covalent or non-covalent binding of the barcode to the target molecule) or indirect (for example, via an additional molecule, for example, a specific binding agent, such as an antibody (or other protein) or a barcode receiving adaptor (or other nucleic acid molecule). Target molecule and/or target nucleic acids can be labeled with multiple nucleic acid barcodes in combinatorial fashion, such as a nucleic acid barcode concatemer. Typically, a nucleic acid barcode is used to identify target molecules and/or target nucleic acids as being from a particular compartment (for example a discrete volume), having a particular physical property (for example, affinity, length, sequence, etc.), or having been subject to certain treatment conditions. Target molecule and/or target nucleic acid can be associated with multiple nucleic acid barcodes to provide information about all of these features (and more). Methods of generating nucleic acid-barcodes are disclosed, for example, in International Patent Application Publication No. WO/2014/047561.

Enzymes

The application further provides orthologs of C2c2 which demonstrate robust activity making them particularly suitable for different applications of RNA cleavage and detection. These applications include but are not limited to those described herein. More particularly, an ortholog which is demonstrated to have stronger activity than others tested is the C2c2 ortholog identified from the organism *Leptotrichia wadei* (LwC2c2). The application thus provides methods for modifying a target locus of interest, comprising delivering to said locus a non-naturally occurring or engineered composition comprising a C2c2 effector protein, more particularly a C2c2 effector protein with increased activity as described herein and one or more nucleic acid components, wherein at least the one or more nucleic acid components is engineered, the one or more nucleic acid components directs the complex to the target of interest and the effector protein forms a complex with the one or more nucleic acid components and the complex binds to the target locus of interest. In particular embodiments, the target locus of interest comprises RNA. The application further provides for the use of the Cc2 effector proteins with increased activity in RNA sequence specific interference, RNA sequence specific gene regulation, screening of RNA or RNA products or lincRNA or non-coding RNA, or nuclear RNA, or mRNA, mutagenesis, Fluorescence in situ hybridization, or breeding.

The embodiments disclosed herein may also be carried out using a lateral flow assay such as that disclosed in U.S. Provisional Application Nos. 62/568,309; 62/610,144; and 62/623,529, as well as in Gootenberg et al. (Science doi: 10.1126/science.aaq0179 (2018)).

Further embodiments of the invention are described in the following numbered paragraphs.

1. A nucleic acid detection system comprising:
   a CRISPR system comprising an effector protein and one or more guide RNAs designed to bind to corresponding target molecules; and an RNA-based masking construct.
2. A polypeptide detection system comprising:
   a CRISPR system comprising an effector protein and one or more guide RNAs designed to bind to a trigger RNA; an RNA-based masking construct; and one or more detection aptamers comprising a masked RNA polymerase promoter binding site or a masked primer binding site.
3. The system of paragraphs 1 or 2, further comprising nucleic acid amplification reagents.
4. The system of paragraph 1, wherein the target molecule is a target DNA and the system further comprises a primer that binds the target DNA and comprises an RNA polymerase promoter.
5. The system of any one of paragraphs 1 to 4, wherein the CRISPR system effector protein is an RNA-targeting effector protein.
6. The system of paragraph 5, the RNA-targeting effector protein comprises one or more HEPN domains.
7. The system of paragraph 6, wherein the one or more HEPN domains comprise a RxxxxH motif sequence.
8. The system of paragraph 7, wherein the RxxxH motif comprises a R[N/H/K]$X_1X_2X_3$H sequence.
9. The system of paragraph 8, wherein $X_1$ is R, S, D, E, Q, N, G, or Y, and $X_2$ is independently I, S, T, V, or L, and $X_3$ is independently L, F, N, Y, V, I, S, D, E, or A.
10. The system of anyone of paragraphs 1 to 9, wherein the CRISPR RNA-targeting effector protein is C2c2.
11. The system of paragraph 6, wherein the CRISPR RNA-targeting effector protein is C2c2.
12. The system of paragraph 11, wherein the C2c2 is within 20 kb of a Cas 1 gene.
13. The system of paragraph 12, wherein the C2c2 effector protein is from an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter,* and *Lachnospira*.
14. The system of paragraph 13, wherein the C2c2 effector protein is from an organism selected from the group consisting of: *Leptotrichia shahii; Leptotrichia wadei* (Lw2); *Listeria seeligeri*; Lachnospiraceae *bacterium* MA2020; Lachnospiraceae *bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae *bacterium* FSL M6-0635; *Leptotrichia wadei* F0279; *Rhodobacter capsulatus* SB 1003; *Rhodobacter capsulatus*

R121; *Rhodobacter capsulatus* DE442; *Leptotrichia buccalis* C-1013-b; Herbinix hemicellulosilytica; [*Eubacterium*] *rectale*; Eubacteriaceae bacterium CHKCI004; *Blautia* sp. *Marseille*-P2398; and *Leptotrichia* sp. oral taxon 879 str. F0557. Twelve (12) further non-limiting examples are: Lachnospiraceae bacterium NK4A144; *Chloroflexus aggregans*; *Demequina aurantiaca*; Thalassospira sp. TSL5-1; Pseudobutyrivibrio sp. OR37; *Butyrivibrio* sp. YAB3001; *Blautia* sp. *Marseille*-P2398; *Leptotrichia* sp. *Marseille*-P3007; *Bacteroides* ihuae; Porphyromonadaceae bacterium KH3CP3RA; *Listeria riparia*; and *Insolitispirillum peregrinum*.

15. The system of paragraph 14, wherein the C2c2 effector protein is a *L. wadei* F0279 or *L. wadei* F0279 (Lw2) C2c2 effector protein.

16. The system of any one of paragraphs 1 to 15, wherein the RNA-based masking construct suppresses generation of a detectable positive signal.

17. The system of paragraph 16, wherein the RNA-based masking construct suppresses generation of a detectable positive signal by masking the detectable positive signal or generating a detectable negative signal instead.

18. The system of paragraph 16, wherein the RNA-based masking construct comprises a silencing RNA that suppresses generation of a gene product encoded by a reporting construct, wherein the gene product generates the detectable positive signal when expressed.

19. The system of paragraph 16, wherein the RNA-based masking construct is a ribozyme that generates the negative detectable signal, and wherein the positive detectable signal is generated when the ribozyme is deactivated.

20. The system of paragraph 19, wherein the ribozyme converts a substrate to a first color and wherein the substrate converts to a second color when the ribozyme is deactivated.

21. The system of paragraph 16, wherein the RNA-based masking agent is an RNA aptamer and/or comprises an RNA-tethered inhibitor.

22. The system of paragraph 21, wherein the aptamer or RNA-tethered inhibitor sequesters an enzyme, wherein the enzyme generates a detectable signal upon release from the aptamer or RNA tethered inhibitor by acting upon a substrate.

23. The system of paragraph 21, wherein the aptamer is an inhibitory aptamer that inhibits an enzyme and prevents the enzyme from catalyzing generation of a detectable signal from a substrate or wherein the RNA-tethered inhibitor inhibits an enzyme and prevents the enzyme from catalyzing generation of a detectable signal from a substrate.

24. The system of paragraph 23, wherein the enzyme is thrombin, horseradish peroxidase, beta-galactosidase, or calf alkaline phosphatase.

25. The system of paragraph 24, wherein the enzyme is thrombin and the substrate is para-nitroanilide covalently linked to a peptide substrate for thrombin, or 7-amino-4-methylcoumarin covalently linked to a peptide substrate for thrombin.

26. The system of paragraph 21, wherein the aptamer sequesters a pair of agents that when released from the aptamers combine to generate a detectable signal.

27. The system of paragraph 16, wherein the RNA-based masking construct comprises an RNA oligonucleotide to which a detectable ligand and a masking component are attached.

28. The system of paragraph 16, wherein the RNA-based masking construct comprises a nanoparticle held in aggregate by bridge molecules, wherein at least a portion of the bridge molecules comprises RNA, and wherein the solution undergoes a color shift when the nanoparticle is disbursed in solution.

29. The system of paragraph 28, wherein the nanoparticle is a colloidal metal.

30. The system of paragraph 29, wherein the colloidal metal is colloidal gold.

31. The system of paragraph 16, wherein the RNA-based masking construct comprising a quantum dot linked to one or more quencher molecules by a linking molecule, wherein at least a portion of the linking molecule comprises RNA.

32. The system of paragraph 16, wherein the RNA-based masking construct comprises RNA in complex with an intercalating agent, wherein the intercalating agent changes absorbance upon cleavage of the RNA.

33. The system of paragraph 32, wherein the intercalating agent is pyronine-Y or methylene blue.

34. The system of paragraph 16, wherein the detectable ligand is a fluorophore and the masking component is a quencher molecule.

35. The system of paragraph 16, wherein said masking construct comprises an RNA oligonucleotide designed to bind a G-quadruplex forming sequence, wherein a G-quadruplex structure is formed by the G-quadruplex forming sequence upon cleavage of the masking construct, and wherein the G-quadruplex structure generates a detectable positive signal.

36. The system according to any of paragraphs 1 to 35, wherein the one or more guide RNAs designed to bind to corresponding target molecules comprise a synthetic mismatch.

37. The system according to paragraph 36, wherein said mismatch is up- or downstream of a SNP or other single nucleotide variation in said target molecule.

38. The detection system of paragraphs 36 or 37, wherein said synthetic mismatch or other single nucleotide variation in said guide RNA is at position 3, 4, 5, or 6 of the spacer, preferably position 3.

39. The detection system of any of paragraphs 36 to 38, wherein said synthetic mismatch in said guide RNA is at position 1, 2, 3, 4, 5, 6, 7, 8, or 9 of the spacer, preferably position 5.

40. The detection system of any of paragraphs 36 to 39, wherein said synthetic mismatch is 1, 2, 3, 4, or 5 nucleotides upstream or downstream, preferably 2 nucleotides, preferably downstream of said SNP or other single nucleotide variation in said guide RNA.

41. The detection system of any of paragraphs 36 to 40, wherein said guide RNA comprises a spacer which is truncated relative to a wild-type spacer.

42. The detection system of paragraph 41, wherein said guide RNA comprises a spacer which comprises less than 28 nucleotides, preferably between and including 20 to 27 nucleotides.

43. The detection system of paragraph 42, wherein guide RNA comprises a spacer which consists of 20-25 nucleotides or 20-23 nucleotides, such as preferably 20 or 23 nucleotides.

44. The detection system of any one of paragraphs 1 to 43, wherein the one or more guide RNAs are designed to detect a single nucleotide polymorphism in a target RNA or DNA, or a splice variant of an RNA transcript.
45. A method for detecting viruses in samples, comprising:
    distributing a sample or set of samples into one or more individual discrete volumes, the individual discrete volumes comprising a CRISPR system of any one of paragraphs 1 to 44;
    incubating the sample or set of samples under conditions sufficient to allow binding of the one or more guide RNAs to one or more target molecules;
    activating the CRISPR effector protein via binding of the one or more guide RNAs to the one or more target molecules, wherein activating the CRISPR effector protein results in modification of the RNA-based masking construct such that a detectable positive signal is generated; and
    detecting the detectable positive signal, wherein detection of the detectable positive signal indicates a presence of one or more viruses in the sample.
46. The method of paragraph 45, wherein the sample comprises two or more viruses, and wherein the method distinguishes between the two or more viruses.
47. The method of paragraphs 45 or 46, wherein the guide RNAs detect single nucleotide variants of the one or more viruses.
48. The method of paragraph 47, wherein the guide RNAs further comprise one or more synthetic mismatches.
49. The method of any one of paragraphs 45 to 47, wherein the guide RNAs of the one or more CRISPR systems comprise a pan-viral guide RNA set that detects each virus and/or viral strain in a set of viruses.
50. The method of paragraph 49, wherein the guide RNAs are derived using a set cover approach.
51. A method of detecting viruses, comprising:
    exposing a CRISPR system of any one of paragraphs 1 to 36 to a sample;
    activating the RNA effector protein via binding of the one or more guide RNAs to the one or more microbe-specific target RNAs or one or more trigger RNAs such that a detectable positive signal is produced; and
    detecting the detectable positive signal, wherein detection of the detectable positive signal indicates a presence of one or more viruses in the sample.
52. The method of paragraph 51, wherein the CRISPR system is on a substrate, and wherein the substrate is exposed to the sample.
53. The method of paragraph 52, wherein the same or a different CRISPR system is applied to multiple discrete locations on the substrate.
54. The method of paragraph 53, wherein the same or a different CRISPR system is applied to multiple discrete locations on the substrate.
55. The method of any of paragraphs 52 to 54, wherein the substrate is a flexible materials substrate.
56. The method of paragraph 55, wherein the flexible materials substrate is a paper substrate, a fabric substrate, or a flexible polymer-based substrate.
57. The method of paragraph 54, wherein the different CRISPR system detects a different microbe at each location.
58. The method of paragraph 55, wherein the substrate is exposed to the sample passively, by temporarily immersing the substrate in a fluid to be sampled, by applying a fluid to be tested to the substrate, or by contacting a surface to be tested with the substrate.
59. The method of paragraph 58, wherein the sample is a biological or environmental sample.
60. The method of paragraph 59, wherein the environmental sample is obtained from a food sample, a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof.
61. The method of paragraph 59, wherein the biological sample is obtained from a tissue sample, saliva, blood, plasma, sera, stool, urine, sputum, mucous, lymph, synovial fluid, cerebrospinal fluid, ascites, pleural effusion, seroma, pus, or swab of skin or a mucosal membrane surface.
62. The method of any one of paragraphs 59 to 61, wherein the environmental sample or biological samples are crude samples and/or wherein the one or more target molecules are not purified or amplified from the sample prior to application of the method.
63. A method for monitoring viral disease outbreaks and/or evolution, comprising:
    exposing a CRISPR system of any one of paragraphs 1 to 36 to a sample:
    activating the RNA effector protein via binding of the one or more guide RNAs to the one or more target sequences comprising non-synonymous viral mutations such that a detectable positive signal is produced; and
    detecting the detectable positive signal, wherein detection of the detectable positive signal indicates a type of viral strain that is present in the sample.
64. The method of paragraph 63, wherein exposing the CRISPR system comprises locating one or more CRISPR systems within one or more individual discrete volumes and adding a sample or sample aliquot to the one or more individual discrete volumes.
65. A method for screening samples for viral antigens and/or viral specific antibodies comprising:
    exposing a CRISPR system of any one of paragraphs 2 to 36 to a sample, wherein the one or more aptamers bind to one or more viral antigens or one or more viral-specific antibodies, and wherein the aptamers encode a barcode that identifies the one or more viral antigens or one or more viral-specific antibodies that the one or more aptamers bind to, and wherein the guide-RNAs are designed to detect the barcode;
    activating the RNA effector protein via binding of the one or more guide RNAs to the one or more microbe-specific target RNAs or one or more trigger RNAs such that a detectable positive signal is produced; and
    detecting the detectable positive signal, wherein detection of the detectable positive signal indicates a presence of one or more viral antigens or one/or more viral specific antibodies in the sample.
66. The method of any one of paragraphs 45 to 65, wherein the virus is a DNA virus.
67. The method of paragraph 66, wherein the DNA virus is a is a Myoviridae, Podoviridae, Siphoviridae, Alloherpesviridae, Herpesviridae (including human herpes virus, and Varicella Zozter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, or combination thereof.

68. The method of any one of paragraphs 45 to 65, wherein the viral infection is caused by a double-stranded RNA virus, a positive sense RNA virus, a negative sense RNA virus, a retrovirus, or a combination thereof.

69. The method of paragraph 68, wherein the virus is a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus.

70. The method of paragraph 68, wherein the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

71. A method for detecting one or more microbes in a sample, comprising:
contacting a sample with a nucleic acid detection system according to any of paragraphs 1 to 44; and
applying said contacted sample to a lateral flow immunochromatographic assay.

72. The method according to paragraph 71, wherein said nucleic acid detection system comprises an RNA-based masking construct comprising a first and a second molecule, and wherein said lateral flow immunochromatographic assay comprises detecting said first and second molecule, preferably at discrete detection sites on a lateral flow strip.

73. The method according to paragraph 72, said first molecule and said second molecule is detected by binding to an antibody recognizing said first or second molecule and detecting said bound molecule, preferably with sandwich antibodies.

74. The method according to paragraph 72 or 73, wherein said lateral flow strip comprises an upstream first antibody directed against said first molecule, and a downstream second antibody directed against said second molecule, and wherein uncleaved RNA-based masking construct is bound by said first antibody if the target nucleic acid is not present in said sample, and wherein cleaved RNA-based masking construct is bound both by said first antibody and said second antibody if the target nucleic acid is present in said sample.

75. A method of detecting a virus, comprising:
obtaining a sample from a subject, wherein the sample is urine, sera, blood or saliva;
amplifying the sample RNA;
combining the sample with an effector protein, one or more guide RNAs designed to bind to corresponding virus-specific target molecules, and an RNA-based masking construct,
activating the RNA effector protein via binding of the one or more guide RNAs to the one or more virus-specific target RNAs, wherein activating the CRISPR effector protein results in modification of the RNA-based masking construct such that a detectable positive signal is produced; and
detecting the signal, wherein detection of the signal indicates the presence of the virus; and
wherein the method does not include a step of extracting RNA from the sample.

76. The method of paragraph 75, wherein the amplification step is of a duration selected from the group consisting of: 2 hours, 1 hour, 30 minutes, 20 minutes and 10 minutes.

77. The method of paragraph 75, wherein the detection step is of a duration selected from the group consisting of: 3 hours, 2 hours, 1 hour, 30 minutes, 20 minutes and 10 minutes.

78. The method of paragraph 75, wherein the volume of sample required for detection is 100 µl to 1 µl.

79. The method of paragraph 75, wherein the virus is Zika virus.

80. The method of paragraph 75, wherein the sample comprises two or more viruses and wherein the method distinguishes between the two or more viruses.

81. The method of paragraph 75, wherein the RNA-based masking construct comprises:

EXAMPLES

Example 1—General Protocols

There are two ways to perform a C2c2 diagnostic test for DNA and RNA. This protocol may also be used with protein detection variants after delivery of the detection aptamers. The first is a two-step reaction where amplification and C2c2 detection are done separately. The second is where everything is combined in one reaction, and this is called a two-step reaction. It is important to keep in mind that amplification might not be necessary for higher concentration samples, so it is good to have a separate C2c2 protocol that does not have amplification built in.

TABLE 10

| CRISPR Effector Only - No amplification: | |
|---|---|
| Component | Volume (µL) |
| Protein (44 nM final) | 2 |
| crRNA (12 nM final) | 1 |
| background target (100 ng total) | 1 |
| Target RNA (variable) | 1 |
| RNA sensor probe (125 nM) | 4 |
| MgCl$_2$ (6 mM final) | 2 |
| Reaction Buffer 10x | 2 |
| RNAse Inhibitors (murine from NEB) | 2 |
| H$_2$O | 5 |
| total | 20 |

Reaction buffer is: 40 mM Tris-HCl, 60 mM NaCl, pH 7.3.

Perform this reaction for 20 min-3 hrs at 37° C. Read out with excitation: 485 nm/20 nm, emission: 528 nm/20 nm. A signal for single molecule sensitivity may be detected beginning at 20 min but of course sensitivity is higher for longer reaction times. Two step reaction:

TABLE 11

RPA amplification mix

| Component | Volume (μL) |
|---|---|
| Primer A (100 μM) | 0.48 |
| Primer B (100 μM) | 0.48 |
| RPA Buffer | 59 |
| MgAc | 5 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |
| T7 Polymerase (from NEB kit) | 2 |
| H$_2$O | 25 |
| Total | 104.96 |

Mix this reaction together and then re-suspend two to three tubes of freeze-dried enzyme mix). Add 5 μL of 280 mM MgAc to the mix to begin the reaction. Perform reaction for 10-20 min. Each reaction is 20 μL, so this is enough for up to five reactions.

TABLE 12

C2c2 detection mix

| Component | Volume (μL) |
|---|---|
| Protein (44 nM final) | 2 |
| crRNA (12 nM final) | 1 |
| background target (100 ng total) | 1 |
| RPA reaction | 1 |
| RNA sensor probe (125 nM) | 4 |
| MgCl$_2$ (6 mM final) | 2 |
| Reaction Buffer 10x | 2 |
| RNAse Inhibitors (murine from NEB) | 2 |
| H$_2$O | 5 |
| Total | 20 |

Reaction buffer is: 40 mM Tris-HCl, 60 mM NaCl, pH 7.3.

Perform this for 20 min-3 hours. Minimum detection time is about 20 min. to see single molecule sensitivity. Performing the reaction for longer only boosts the sensitivity.

TABLE 13

One pot reaction:

| Component | Volume (μL) |
|---|---|
| Primer A (100 μM) | 0.48 |
| Primer B (100 μM) | 0.48 |
| RPA Buffer | 59 |
| MgAc | 5 |
| Lw2C2c2 (44 nM final) | 2 |
| crRNA (12 nM final) | 2 |
| Background RNA (from 250 ng/μL) | 2 |
| RNAse alert substr (after resuspending in 20 μL) | 5 |
| murine RNAse inhib from NEB | 10 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |

TABLE 13-continued

One pot reaction:

| Component | Volume (μL) |
|---|---|
| T7 Polymerase (from NEB kit) | 2 |
| H$_2$O | 4 |
| Total | 104.96 |

The NEB kit referenced is the HighScribe T7 High Yield Kit. To resuspend buffer, use a 1.5× concentration: resuspend three tubes of freeze-dried substrate in 59 μL of buffer and use in the mix above. Each reaction is 20 μL so this is enough for 5 reactions worth. Single molecule sensitivity with this reaction has been observed in as early as 30-40 min.

Example 2—C2C2 from *Leptotrichia wadei* Mediates Highly Sensitive and Specific Detection of DNA and RNA Rapid, inexpensive, and sensitive nucleic acid detection may aid point-of-care pathogen detection, genotyping, and disease monitoring. The RNA-guided, RNA-targeting CRISPR effector Cas13a (previously known as C2c2) exhibits a "collateral effect" of promiscuous RNAse activity upon target recognition. We combine the collateral effect of Cas13a with isothermal amplification to establish a CRISPR-based diagnostic (CRISPR-Dx), providing rapid DNA or RNA detection with attomolar sensitivity and single-base mismatch specificity. We use this Cas13a-based molecular detection platform, termed SHERLOCK (Specific High Sensitivity Enzymatic Reporter UnLOCKing), to detect specific strains of Zika and Dengue virus, distinguish pathogenic bacteria, genotype human DNA, and identify cell-free tumor DNA mutations. Furthermore, SHERLOCK reaction reagents can be lyophilized for cold-chain independence and long-term storage, and readily reconstituted on paper for field applications.

Figure 17:
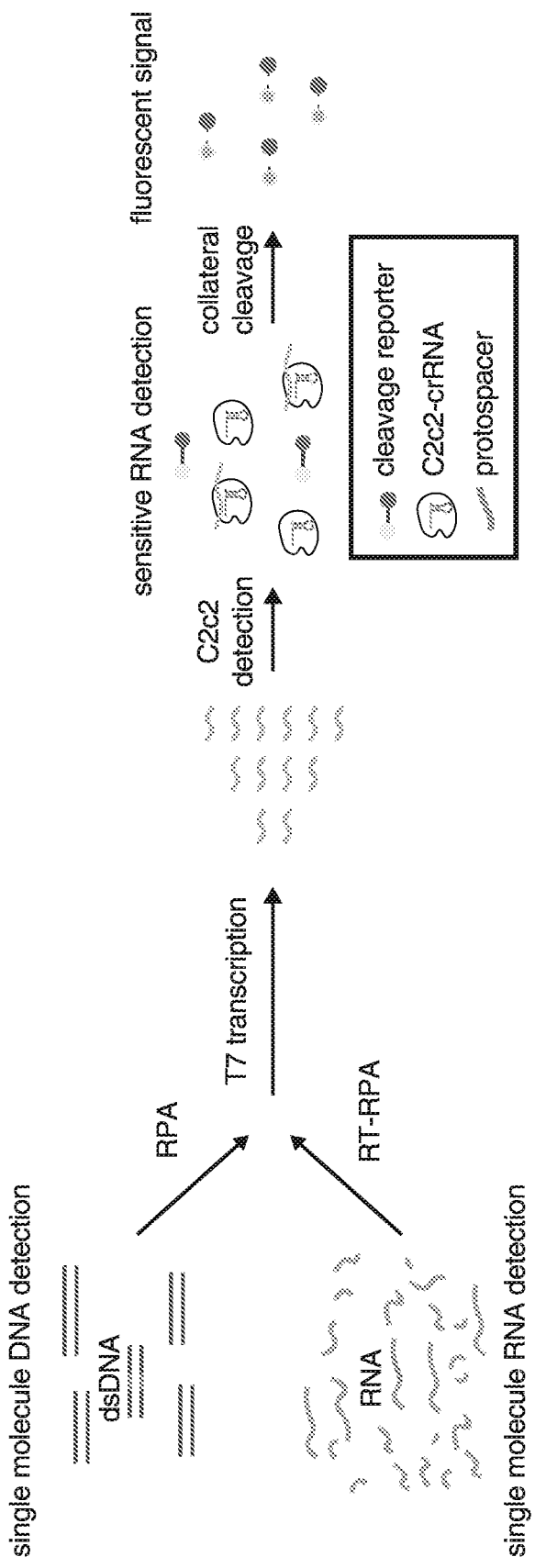
FIG. 17—schematic of SHERLOCK; provides a schematic showing detection of both DNA or RNA targets via incorporation of an RPA or a RT-RPA step accordingly. Upon recognition of target RNA, the collateral effect causes C2c2 to cut the cleavage reporter, generating fluorescence. Single-molecule amounts of RNA or DNA can be amplified to DNA via recombinase polymerase amplification (RPA) and transcribed to produce RNA, which is then detected by C2c2.

The ability to rapidly detect nucleic acids with high sensitivity and single-base specificity on a portable platform may aid in disease diagnosis and monitoring, epidemiology, and general laboratory tasks. Although methods exist for detecting nucleic acids (1-6), they have trade-offs among sensitivity, specificity, simplicity, cost, and speed. Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). While some Cas enzymes target DNA (7, 8), single effector RNA-guided RNases, such as Cas13a (previously known as C2c2) (8), can be reprogrammed with CRISPR RNAs (crRNAs) (9-11) to provide a platform for specific RNA sensing. Upon recognition of its RNA target, activated Cas13a engages in "collateral" cleavage of nearby non-targeted RNAs (10). This crRNA-programmed collateral cleavage activity allows Cas13a to detect the presence of a specific RNA in vivo by triggering programmed cell death (10) or in vitro by nonspecific degradation of labeled RNA (10, 12). Here we describe SHERLOCK (Specific High Sensitivity Enzymatic Reporter UnLOCKing), an in vitro nucleic acid detection platform with attomolar sensitivity based on nucleic acid amplification and 3 Cas13a-mediated collateral cleavage of a commercial reporter RNA (12), allowing for real-time detection of the target (FIG. 17).

Methods

Cloning of C2c2 Loci and Proteins for Expression

For the bacterial in vivo efficiency assay, C2c2 proteins from *Leptotrichia wadei* F0279 and *Leptotrichia shahii* were ordered as codon-optimized genes for mammalian expression (Genscript, Jiangsu, China) and cloned into pACYC184 backbones along with the corresponding direct repeats flanking either a beta-lactamase targeting or non-targeting spacer. Spacer expression was driven by a J23119 promoter.

For protein purification, mammalian codon-optimized C2c2 proteins were cloned into bacterial expression vector for protein purification (6×His/Twin Strep SUMO, a pET-based expression vector received as a gift from Ilya Finkelstein).

Bacterial In Vivo C2c2 Efficiency Assay

LwC2c2 and LshC2c2 in vivo efficiency plasmids and a previously described beta-lactamase plasmid (Abudayyeh 2016) were co-transformed into NovaBlue Singles competent cells (Millipore) at 90 ng and 25 ng, respectively. After transformation, dilutions of cells were plated on ampicillin and choramphicol LB-agar plate and incubated overnight at 37 C. Colonies were counted the next day.

Nucleic Acid Target and crRNA Preparation

Nucleic acid targets were PCR amplified with KAPA Hifi Hot Start (Kapa Biosystems), gel extracted and purified using MinElute gel extraction kit (Qiagen). Purified dsDNA was incubated with T7 polymerase overnight at 30° C. using the HiScribe T7 Quick High Yield RNA Synthesis kit (New England Biolabs) and RNA was purified with the MEGAclear Transcription Clean-up kit (Thermo Fisher).

For preparation of crRNA, constructs were ordered as DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNA were purified using RNAXP clean beads (Beckman Coulter) at 2× ratio of beads to reaction volume, with an additional 1.8× supplementation of isopropanol (Sigma).

NASBA Isothermal Amplification

Details of NASBA reaction are described in [Pardee 2016]. For a 20 µL total reaction volume, 6.7 µL of reaction buffer (Life Sciences, NECB-24), 3.3 µL of Nucleotide Mix (Life Sciences, NECN-24), 0.5 µL of nuclease-free water, 0.4 µL of 12.5 µM NASBA primers, 0.1 uL of RNase inhibitor (Roche, 03335402001) and 4 µL of RNA amplicon (or water for the negative control) were assembled at 4° C. and incubated 65° C. for 2 min and then 41° C. for 10 min. 5 µL of enzyme mix (Life Sciences, NEC-1-24) was added to each reaction, and the reaction mixture was incubated at 41° C. for 2 hr. NASBA primers used were 5'-AATTCTAATACGACTCACTATAGGGG-GATCCTCTAGAAATATGGATT-3' (SEQ ID NO: 16) and 5'-CTCGTATGTTGTGTGGAATTGT-3' (SEQ ID NO: 17), and the underlined part indicates T7 promoter sequence.

Recombinase Polymerase Amplification

Primers for RPA were designed using NCBI Primer blast (Ye et al., BMC Bioinformaics 13, 134 (2012) using default parameters, with the exception of amplicon size (between 100 and 140 nt), primer melting temperatures (between 54C and 67C) and primer size (between 30 and 35 nt). Primers were then ordered as DNA (Integrated DNA Technologies).

RPA and RT-RPA reactions run were as instructed with TwistAmp® Basic or TwistAmp® Basic RT (TwistDx), respectively, with the exception that 280 mM MgAc was added prior to the input template. Reactions were run with 1 uL of input for 2 hr at 37C, unless otherwise described.

LwC2c2 Protein Purification

C2c2 bacterial expression vectors were transformed into Rosetta™ 2(DE3) pLysS Singles Competent Cells (Millipore). A 16 mL starter culture was grown in Terrific Broth 4 growth media (12 g/L tryptone, 24 g/L yeast extract, 9.4 g/L K2HPO, 2.2 g/L KH2PO4, Sigma) (TB) was used to inoculate 4 L of TB, which was incubated at 37C, 300 RPM until an OD600 of 0.6. At this time, protein expression was induced by supplementation with IPTG (Sigma) to a final concentration of 500 uM, and cells were cooled to 18° C. for 16 h for protein expression. Cells were then centrifuged at 5200 g, 15 min, 4° C. Cell pellet was harvested and stored at −80° C. for later purification.

All subsequent steps of the protein purification are performed at 4° C. Cell pellet was crushed and resuspended in lysis buffer (20 mM Tris-Hcl, 500 mM NaCl, 1 mM DTT, pH 8.0) supplemented with protease inhibitors (Complete Ultra EDTA-free tablets), lysozyme, and benzonase followed by sonication (Sonifier 450, Branson, Danbury, CT) with the following conditions: amplitude of 100 for 1 second on and 2 seconds off with a total sonication time of 10 minutes. Lysate was cleared by centrifugation for 1 hour at 4° C. at 10,000 g and the supernatant was filtered through a Stericup 0.22-micron filter (EMD Millipore). Filtered supernatant was applied to StrepTactin Sepharose (GE) and incubated with rotation for 1 hour followed by washing of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (ThermoFisher) and incubated overnight at 4° C. with rotation. Digestion was confirmed by SDS-PAGE and Coomassie Blue staining and the protein eluate was isolated by spinning the resin down. Protein was loaded onto a 5 mL HiTrap SP HP cation exchange column (GE Healthcare Life Sciences) via FPLC (AKTA PURE, GE Healthcare Life Sciences) and eluted over a salt gradient from 130 mM to 2M NaCl in elution buffer (20 mM Tris-HCl, 1 mM DTT, 5% Glycerol, pH 8.0). The resulting fractions were tested for presence of LwC2c2 by SDS-PAGE and fractions containing the protein were pooled and concentrated via a Centrifugal Filter Unit to 1 mL in S200 buffer (10 mM HEPES, 1M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing LwC2c2 were pooled, and buffer exchanged into Storage Buffer (600 mM NaCl, 50 mM Tris-HCl pH 7.5, 5% Glycerol, 2 mM DTT) and frozen at −80° C. for storage.

LwC2c2 Collateral Detection

Detection assays were performed with 45 nM purified LwC2c2, 22.5 nM crRNA, 125 nM substrate reporter (Thermo Scientific RNAse Alert v2), 2 µL murine RNase inhibitors, 100 ng of background total RNA and varying amounts of input nucleic acid target, unless otherwise indicated, in nuclease assay buffer (40 mM Tris-HCl, 60 mM NaCl, 6 mM MgCl2, pH 7.3). If the input was amplified DNA including a T7 promoter from an RPA reaction, the above C2c2 reaction was modified to include 1 mM ATP, 1 mM GTP, 1 mM UTP, 1 mM CTP and 0.6 µL T7 polymerase mix (NEB). Reactions were allowed to proceed for 1-3 hours at 37° C. (unless otherwise indicated) on a fluorescent plate reader (BioTek) with fluorescent kinetics measured every 5 minutes.

The one-pot reaction combining, RPA-DNA amplification, T7 polymerase conversion of DNA to RNA and C2c2 detection was performed by integrating the reaction conditions above with the RPA amplification mix. Briefly, in a 50 μL one-pot assay consisted of 0.48 M forward primer, 0.48 μM reverse primer, 1×RPA rehydration buffer, varying amounts of DNA input, 45 nM LwC2c2 recombinant protein, 22.5 nM crRNA, 250 ng background total RNA, 200 nM substrate reporter (RNase alert v2), 4 uL RNase inhibitor, 2 mM ATP, 2 mM GTP, 2 mM UTP, 2 mM CTP, 1 μL T7 polymerase mix, 5 mM MgCl2, and 14 mM MgAc.

Quantitative PCR (qPCR) Analysis with TaqMan Probes

To compare SHERLOCK quantification with other established methods, qPCR on a dilution series of ssDNA 1 was performed. A TaqMan probe and primer set (sequences below) were designed against ssDNA 1 and synthesized with IDT. Assays were performed using the TaqMan Fast Advanced Master Mix (ThermoFisher) and measured on a Roche LightCycler 480.

TABLE 14 qPCR primer/probe sequences.

| Name | Sequence |
| --- | --- |
| Forward Primer | GTG AAA TTG TGA GCG GAT AAA C (SEQ ID NO: 420) |
| Reverse Primer | AAC AGC AAT CTA CTC GAC CTG (SEQ ID NO: 421) |
| TaqMan Probe | /56-FAM/AGGAAACAG/ZEN/CTATGACCATGATTAC GCC/3IABkFQ/ (SEQ ID NOS: 423 and 623) |

Real-Time RPA with SYBR Green II

To compare SHERLOCK quantification with other established methods, we performed RPA on a dilution series of ssDNA 1. To quantitate accumulation of DNA in real-time, we added 1×SYBR Green II (ThermoFisher) to the typical RPA reaction mixture described above, which provides a fluorescent signal that correlates with the amount of nucleic acid. Reactions were allowed to proceed for 1 hour at 37° C. on a fluorescent plate reader (BioTek) with fluorescent kinetics measured every 5 min.

Lentivirus Preparation and Processing

Lentivirus preparation and processing was based on the previously known methods. Briefly, 10 μg pSB700 derivatives that include a Zika or Dengue RNA fragment, 7.5 μg psPAX2, and 2.5 μg pMD2.G were transfected to HEK293FT cells (Life Technologies, R7007) using the HeBS-CaCl2) method. 28 hours after changing media, DMEM supplemented with 10% FBS, 1% penicillin-streptomycin and 4 mM GlutaMAX (ThermoFisher Scientific), the supernatant was filtered using a 0.45 μm syringe filter. ViralBind Lentivirus Purification Kit (Cell Biolabs, VPK-104) and Lenti-X Concentrator (Clontech, 631231) were used to purify and prepare lentiviruses from the supernatant. Viral concentration was quantified using QuickTiter Lentivirus Kit (Cell Biolabs, VPK-112). Viral samples were spiked into 7% human serum (Sigma, H4522), were heated to 95° C. for 2 min and were used as input to RPA.

Isolation and cDNA Purification of Zika Human Serum Samples

Suspected Zika positive human serum or urine samples were inactivated with AVL buffer (Qiagen) and isolation of RNA was achieved with QIAamp Viral RNA minikit (Qiagen). Isolated RNA was converted into cDNA by mixing random primers, dNTPs, and sample RNA followed by heat denaturation for 7 minutes at 70° C. Denatured RNA was then reverse transcribed with Superscript III (Invitrogen) incubating at 22-25° C. for 10 minutes, 50° C. for 45 minutes, 55° C. for 15 minutes, and 80° C. for 10 minutes. cDNA was then incubated for 20 minutes at 37° C. with RNAse H (New England Biolabs) to destroy RNA in the RNA:cDNA hybrids.

Genomic DNA Extraction from Human Saliva 2 mL of saliva was collected from volunteers, who were restricted from consuming food or drink 30 minutes prior to collection. Samples were then processed using QIAamp® DNA Blood Mini Kit (Qiagen) as recommended by the kit protocol. For boiled saliva samples, 400 μL of phosphate buffered saline (Sigma) was added to 100 μL of volunteer saliva and centrifuged for 5 min at 1800 g. The supernatant was decanted, and the pellet was resuspended in phosphate buffered saline with 0.2% Triton X-100 (Sigma) before incubation at 95° C. for 5 min. 1 μL of sample was used as direct input into RPA reactions.

Freeze-Drying and Paper Deposition

A glass fiber filter paper (Whatman, 1827-021) was autoclaved for 90 min (Consolidated Stills and Sterilizers, MKII) and was blocked in 5% nuclease-free BSA (EMD Millipore, 126609-10GM) overnight. After rinsing the papers once with nuclease-free water (Life technologies, AM9932), they were incubated with 4% RNAsecure™ (Life Technologies, AM7006) at 60° C. for 20 min and were rinsed three more times with the nuclease-free water. Treated papers were dried for 20 min at 80° C. on a hot plate (Cole-Parmer, IKA C-Mag HS7) prior to use. 1.8 μL of C2c2 reaction mixture as indicated earlier was put onto the disc (2 mm) that was placed in black, clear bottom 384-well plate (Corning, 3544). For the freeze-dried test, the plate containing reaction mixture discs was flash frozen in liquid nitrogen and was freeze-dried overnight as described in Pardee et al (2). RPA samples were diluted 1:10 in nuclease-free water, and 1.8 μL of the mixture was loaded onto the paper discs and incubated at 37° C. using a plate reader (BioTek Neo).

Bacterial Genomic DNA Extraction

For experiments involving CRE detection, bacterial cultures were grown in lysogeny broth (LB) to mid-log phase, then pelleted and subjected to gDNA extraction and purification using the Qiagen DNeasy Blood and Tissue Kit, using the manufacturer's protocol for either Gram-negative or Gram-positive bacteria, as appropriate. gDNA was quantified by the Quant-It dsDNA assay on a Qubit fluorometer and its quality assessed via 200-300 nm absorbance spectrum on a Nanodrop spectrophotometer.

For experiments discriminating between E. coli and P. aeruginosa, bacterial cultures were grown to early stationary phase in Luria-Bertani (LB) broth. 1.0 mL of both E. coli and P. aeruginosa were processed using the portable Pure-Lyse bacteria gDNA extraction kit (Claremont BioSolutions). 1× binding buffer was added to the bacterial culture before passing through the battery-powered lysis cartridge for three minutes. 0.5× binding buffer in water was used as a wash solution before eluting with 150 μL of water.

Digital Droplet PCR Quantification

To confirm the concentration of ssDNA 1 and ssRNA 1 standard dilutions were used, we performed digital-droplet PCR (ddPCR). For DNA quantification, droplets were made using the ddPCR Supermix for Probes (no dUTP) with PrimeTime qPCR probes/primer assays designed to target the ssDNA 1 sequence. For RNA quantification, droplets were made using the one-step RT-ddPCR kit for probes with PrimeTime qPCR probes/primer assays designed to target the ssRNA 1 sequence. Droplets were generated in either case using the QX200 droplet generator (BioRad) and transferred to a PCR plate. Droplet-based amplification was performed on a thermocycler as described in the kit's protocol and nucleic acid concentrations were subsequently determined via measurement on a QX200 droplet reader.

Synthetic Standards for Human Genotyping

To create standards for accurate calling of human sample genotypes, we designed primers around the SNP target to amplify~200 bp regions from human genomic DNA representing each of the two homozygous genotypes. The heterozygous standard was then made by mixing the homozygous standards in a 1:1 ratio. These standards were then diluted to equivalent genome concentrations (~0.56 fg/µL) and used as input for SHERLOCK alongside real human samples.

Detection of Tumor Mutant Cell Free-DNA (cfDNA)

Mock cfDNA standards simulating actual patient cfDNA samples were purchased from a commercial vendor (Horizon Discovery Group). These standards were provided as four allelic fractions (100% WT and 0.1%, 1%, and 5% mutant) for both the BRAF V600E and EGFR L858R mutants. 3 µL of these standards were provided as input to SHERLOCK.

Analysis of Fluorescence Data

To calculate background subtracted fluorescence data, the initial fluorescence of samples was subtracted to allow for comparisons between different conditions. Fluorescence for background conditions (either no input or no crRNA conditions) were subtracted from samples to generate background subtracted fluorescence.

Guide ratios for SNP or strain discrimination were calculated by dividing each guide by the sum of guide values, to adjust for sample-to-sample overall variation. crRNA ratios for SNP or strain discrimination were calculated to adjust for sample-to-sample overall variation as follows:

$$crRNA\ A_i\ ratio = \frac{(m+n)A_i}{\sum_{i=1}^{m} A_i + \sum_{i=1}^{n} B_i}$$

where Ai and Bi refer to the SHERLOCK intensity values for technical replicate i of the crRNAs sensing allele A or allele B, respectively, for a given individual. Since we typically have four technical replicates per crRNA, m and n are equal to 4 and the denominator is equivalent to the sum of all eight of the crRNA SHERLOCK intensity values for a given SNP locus and individual. Because there are two crRNAs, the crRNA ratio average across each of the crRNAs for an individual will always sum to two. Therefore, in the ideal case of homozygosity, the mean crRNA ratio for the positive allele crRNA will be two and the mean crRNA ratio for the negative allele crRNA will be zero. In the ideal case of heterozygosity, the mean crRNA ratio for each of the two crRNAs will be one.

Characterization of LwCas13a Cleavage Requirements.

The protospacer flanking site (PFS) is a specific motif present near the target site that is required for robust ribonuclease activity by Cas13a. The PFS is located at the 3' end of the target site and was previously characterized for LshCas13a by our group as H (not G) (1). Although this motif is akin to a protospacer adjacent motif (PAM), a sequence restriction for DNA targeting Class 2 systems, it is functionally different as it not involved in preventing self-targeting of CRISPR loci in endogenous systems. Future structural studies of Cas13a will likely elucidate the importance of the PFS for Cas13a:crRNA target complex formation and cleavage activity.

Figure 1:
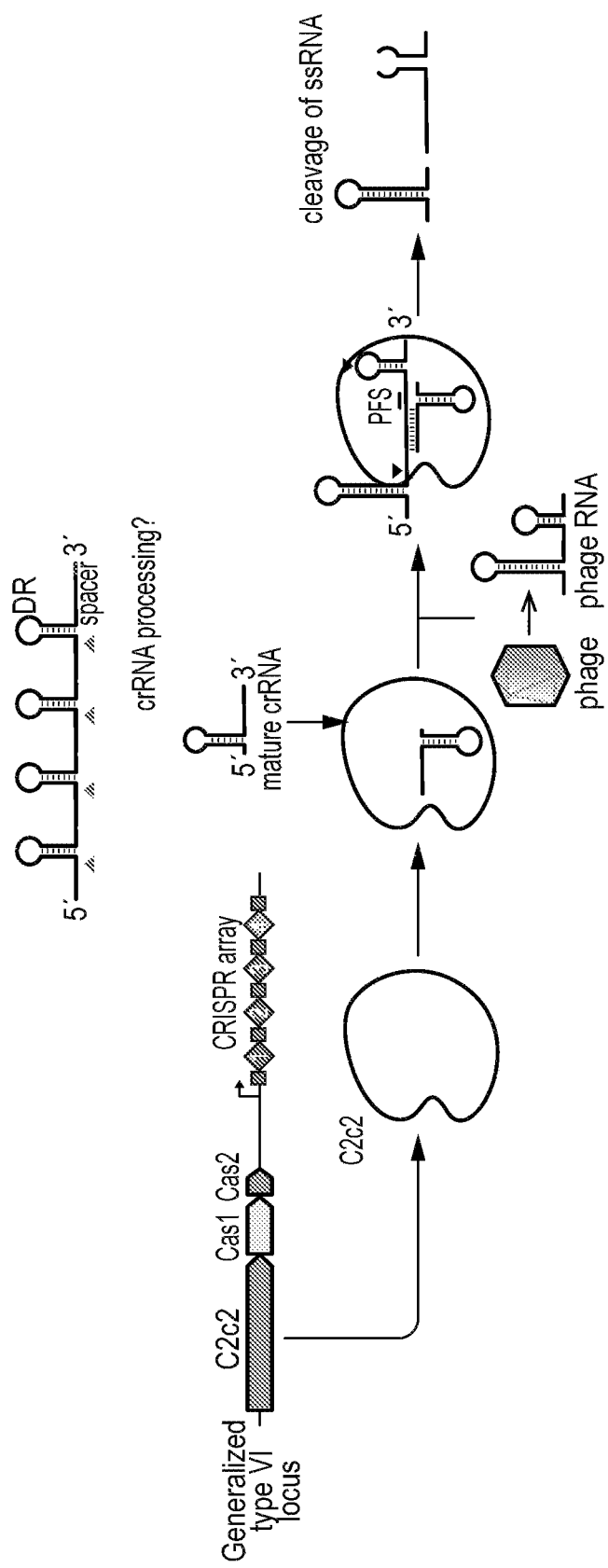
FIG. 1—is a schematics of an example C2c2 based CRISPR effector system.
Figure 2:
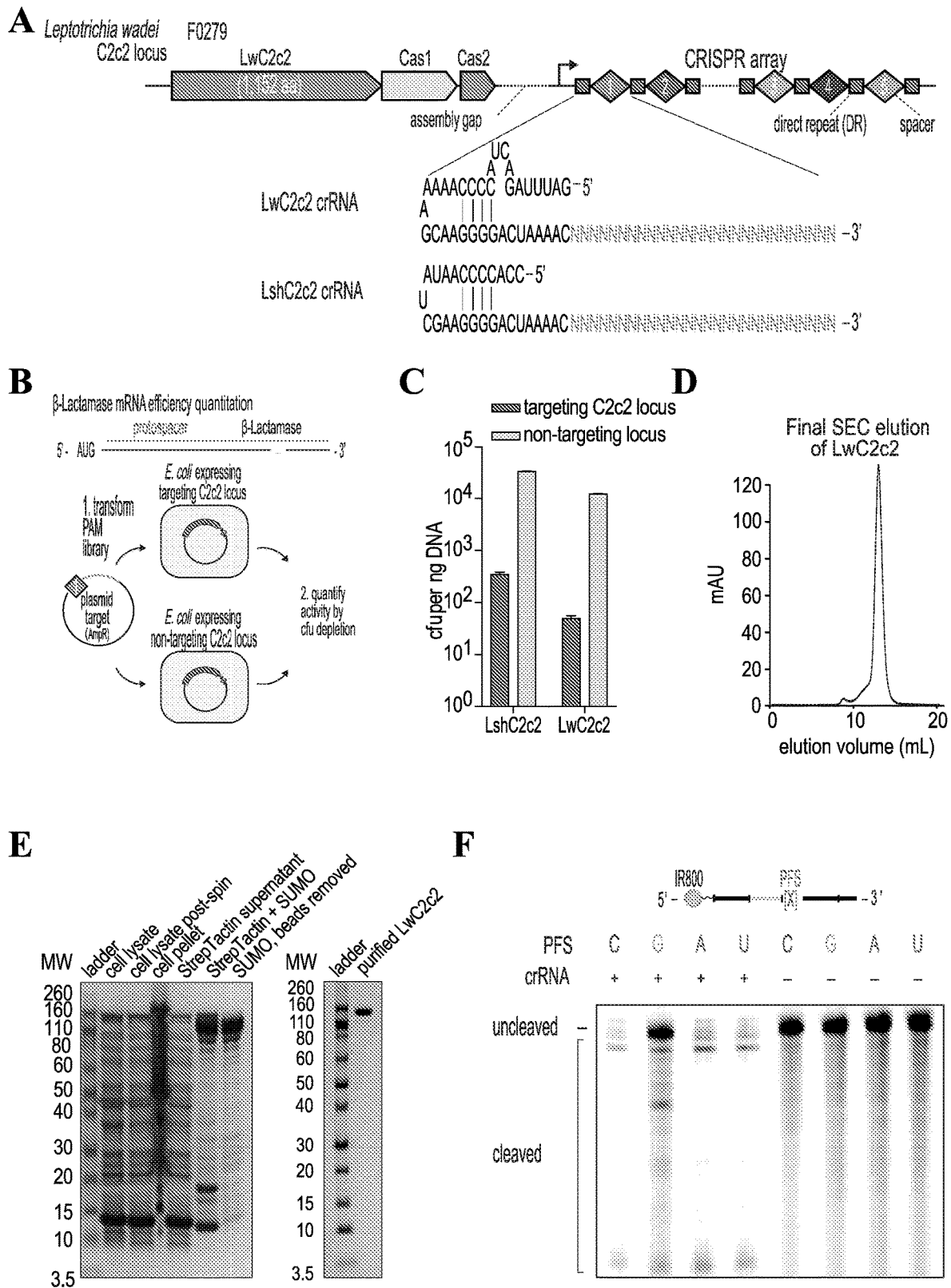
FIG. 2—provides (A) schematic of the CRISPR/C2c2 locus from *Leptotrichia wadei*. Representative crRNA structures from LwC2c2 and LshC2c2 systems are shown. (SEQ ID NOS: 142 and 143) (B) Schematic of in vivo bacterial assay for C2c2 activity. A protospacer is cloned upstream of the beta-lactamase gene in an ampicillin-resistance plasmid, and this construct is transformed into *E. coli* expressing C2c2 in conjunction with either a targeting or non-targeting spacer. Successful transformants are counted to quantify activity. (C) Quantitation of LwC2c2 and LshC2c2 in vivo activity. (n=2 biological replicates; bars represent mean±s.e.m.) (D) Final size exclusion gel filtration of LwC2c2. (E) Coomassie blue stained acrylamide gel of LwC2c2 stepwise purification. (F) Activity of LwC2c2 against different PFS targets. LwC2c2 was targeted against fluorescent RNA with variable 3' PFS flanking the spacer, and reaction products were visualized on denaturing gel. LwC2c2 shows a slight preference against G PFS.
Figure 4:
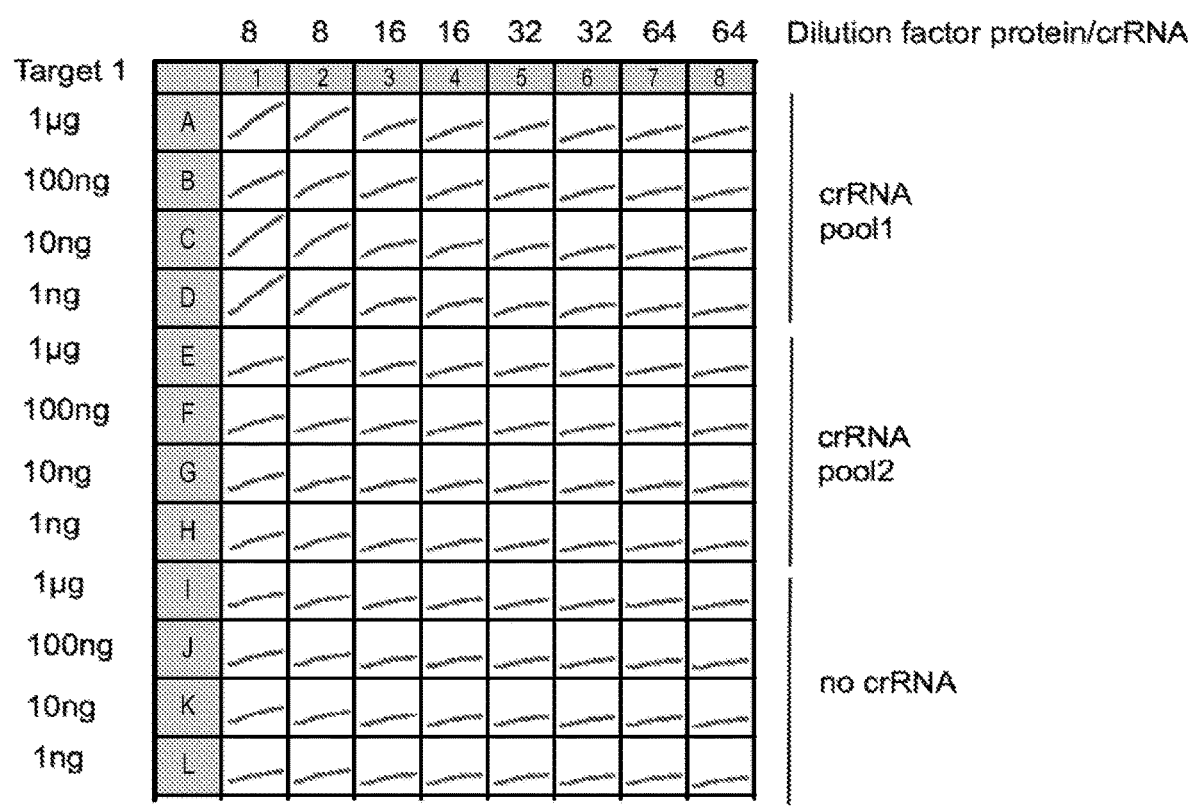
Figure 5:
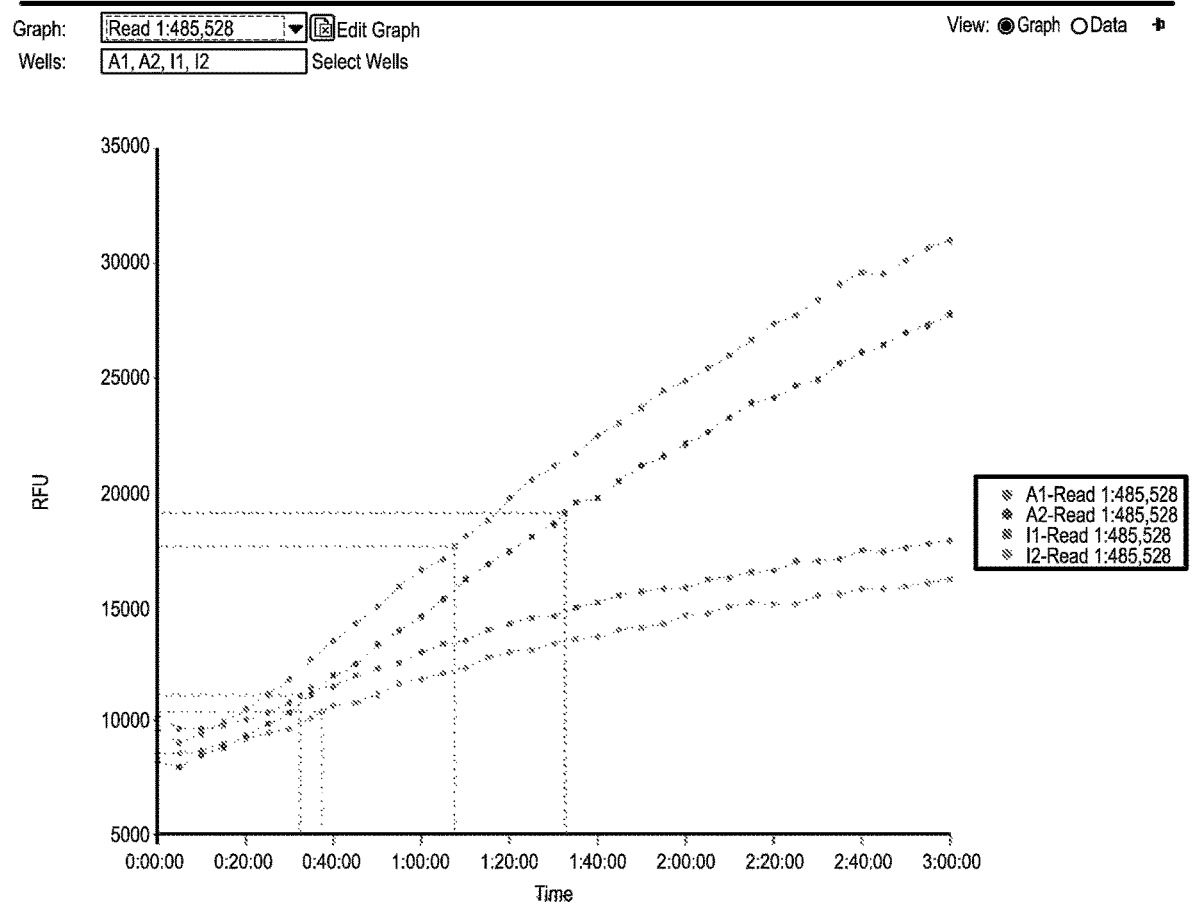
Figure 6:
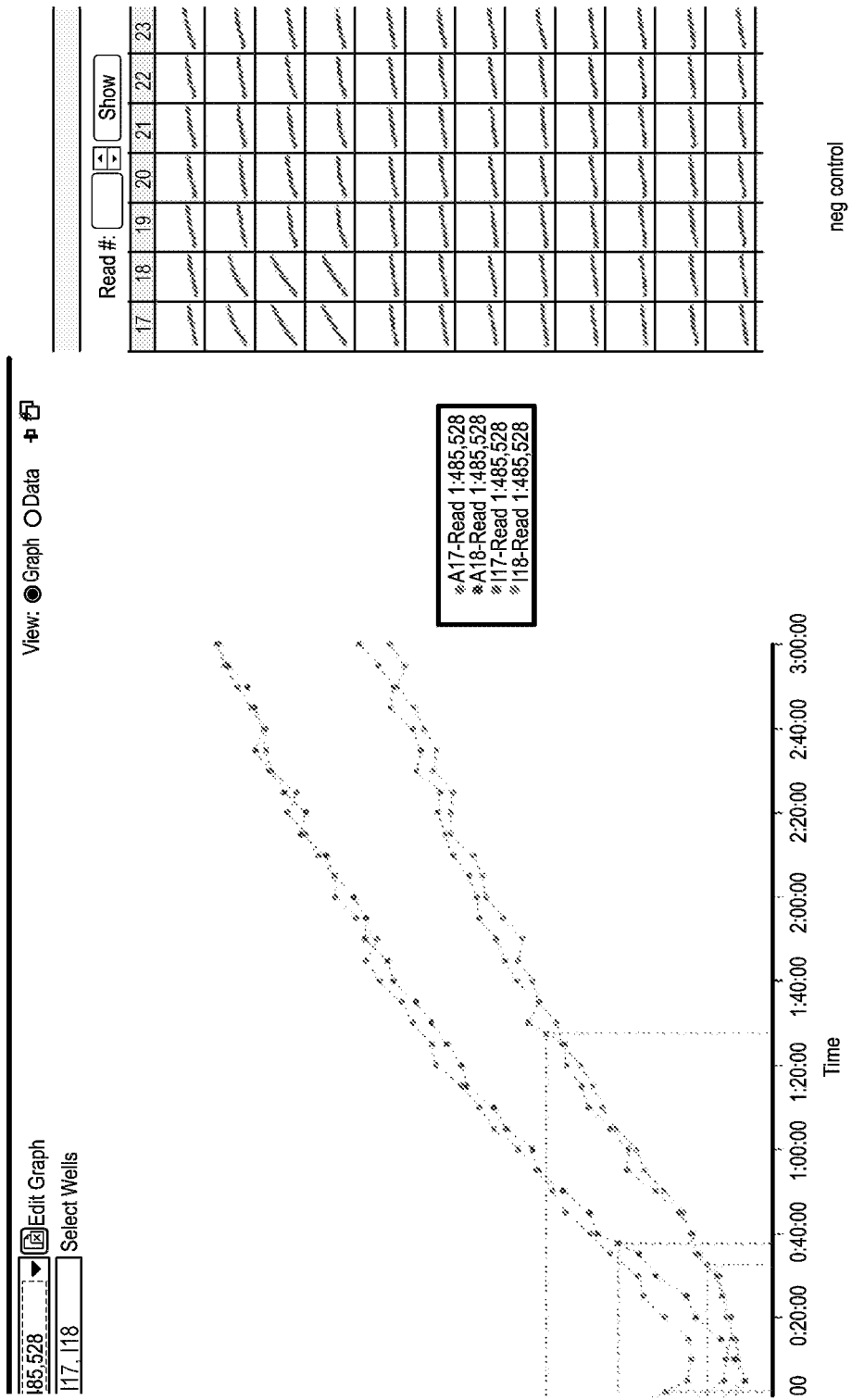
Figure 7:
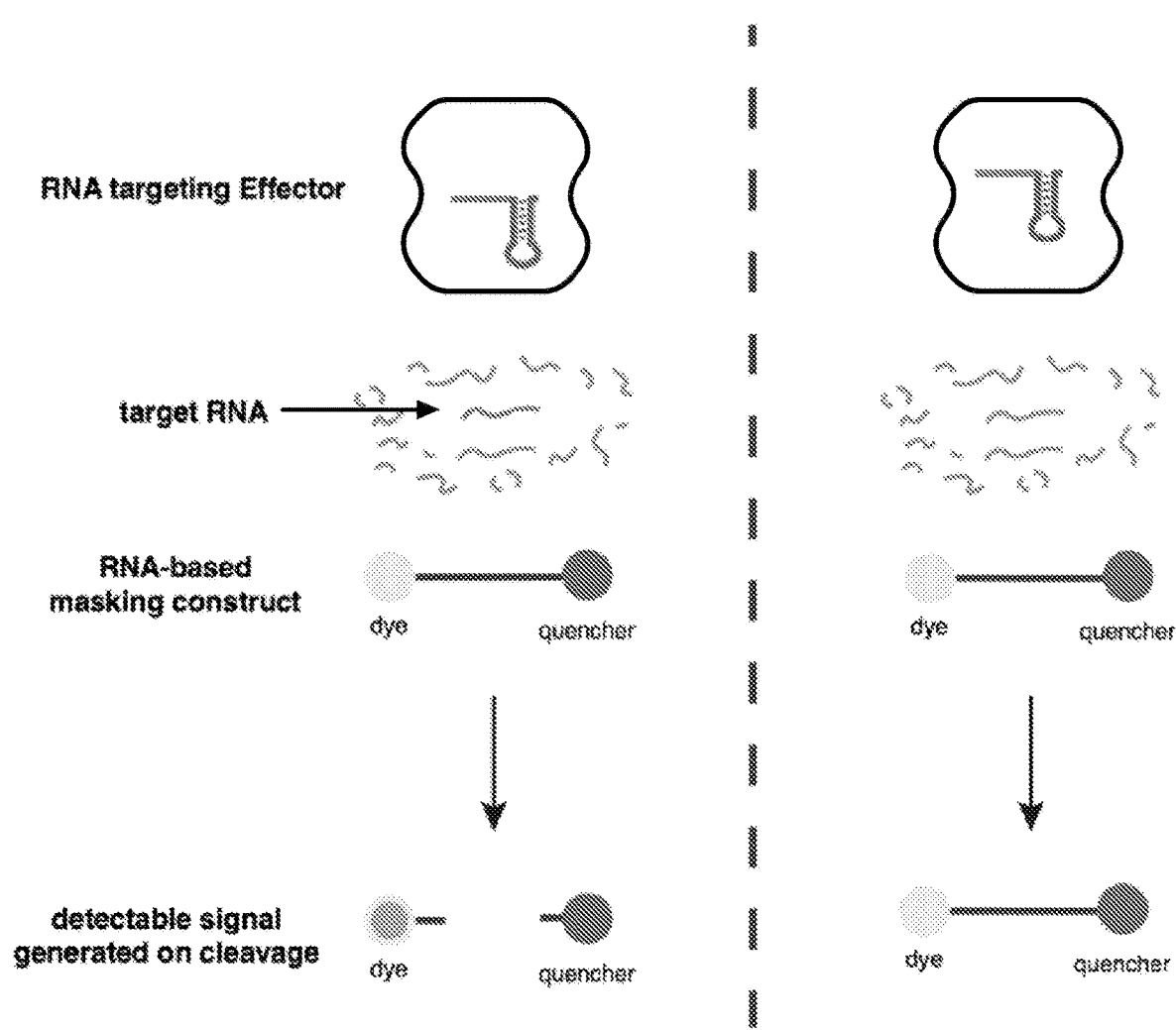
FIG. 7—provides a schematic of an example detection scheme using a masking construct and CRISPR effector protein, in accordance with certain example embodiments.
Figure 8:
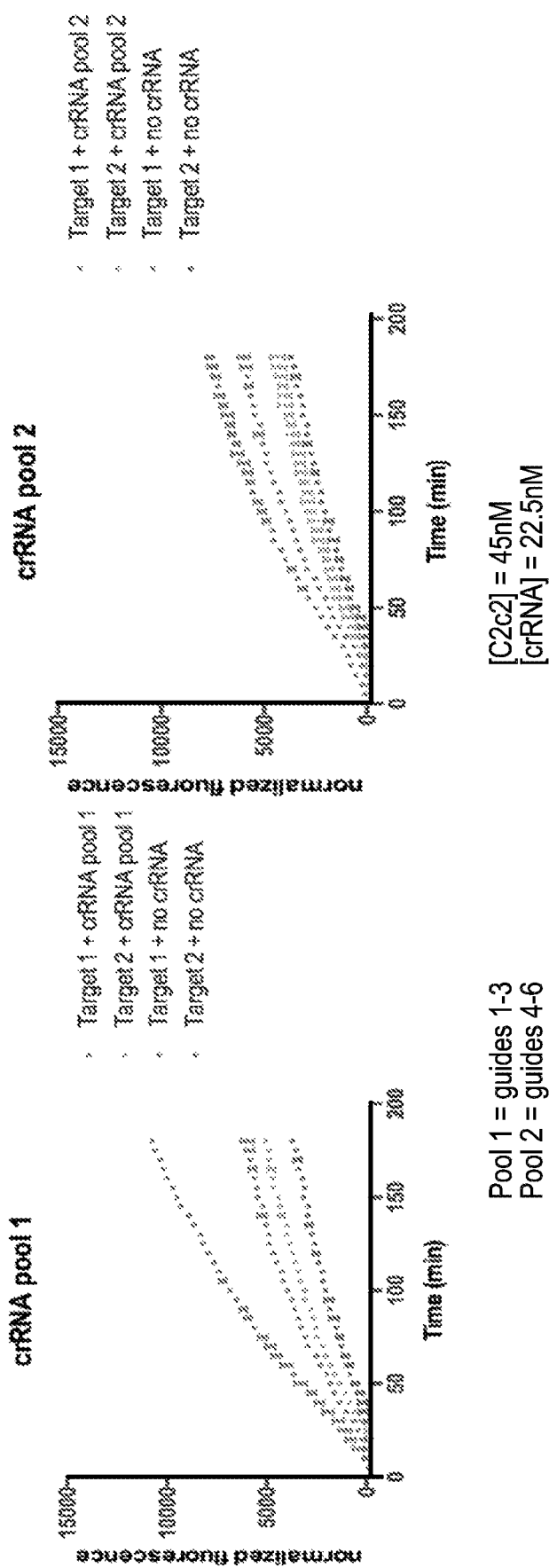
FIG. 8—provides a set of graphs showing changes in fluorescence over time when detecting a target using different pools of guide RNAs.
Figure 9:
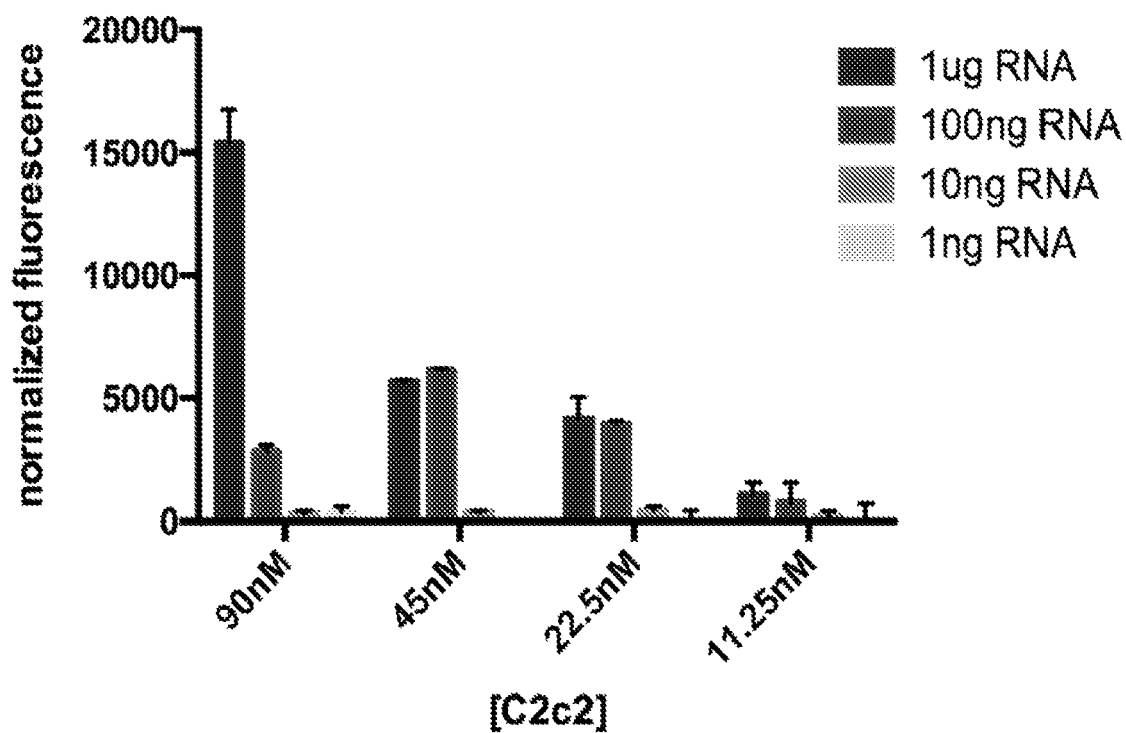
FIG. 9—provides a graph showing the normalized fluorescence detected across different dilutions of target RNA at varying concentrations of CRISPR effector protein.

We purified the recombinant LwCas13a protein from *E. coli* (FIG. 2D-E) and assayed its ability to cleave a 173-nt ssRNA with each possible protospacer flanking site (PFS) nucleotide (A, U, C or G) (FIG. 2F). Similar to LshCas13a, LwCas13a can robustly cleave a target with A, U, or C PFS, with less activity on the ssRNA with a G PFS. Although we see weaker activity against ssRNA 1 with a G PFS, we still see robust detection for the two target sites with G PFS motifs (Table 3; rs601338 crRNA and Zika targeting crRNA 2). It is likely that the H PFS is not required under every circumstance and that in many cases strong cleavage or collateral activity can be achieved with a G PFS.

Discussion of Recombinase Polymerase Amplification (RPA) and Other Isothermal Amplification Strategies.

Recombinase polymerase amplification (RPA) is an isothermal amplification technique consisting of three essential enzymes: a recombinase, single-stranded DNA-binding proteins (SSBs), and a strand displacing polymerase. RPA overcomes many technical difficulties present in other amplification strategies, particularly polymerase chain reaction (PCR), by not requiring temperature regulation as the enzymes all operate at a constant temperature around 37° C. RPA replaces temperature cycling for global melting of the double-stranded template and primer annealing with an enzymatic approach inspired by in vivo DNA replication and repair. Recombinase-primer complexes scan double-stranded DNA and facilitate strand exchange at complementary sites. The strand exchange is stabilized by SSBs, allowing the primer to stay bound. Spontaneous disassembly of the recombinase occurs in its ADP-bound state, allowing a strand-displacing polymerase to invade and extend the primer, allowing amplification without complex instrumentation unavailable in point-of-care and field settings. Cyclic repetition of this process in a temperate range of 37-42° C. results in exponential DNA amplification. The original formulation published uses the *Bacillus subtilis* Pol I (Bsu) as the strand-displacing polymerase, T4 uvsX as the recombinase, and T4 gp32 as the single-stranded DNA binding protein (2), although it is unclear what components are in the current formulation sold by TwistDx used in this study.

Figure 15:
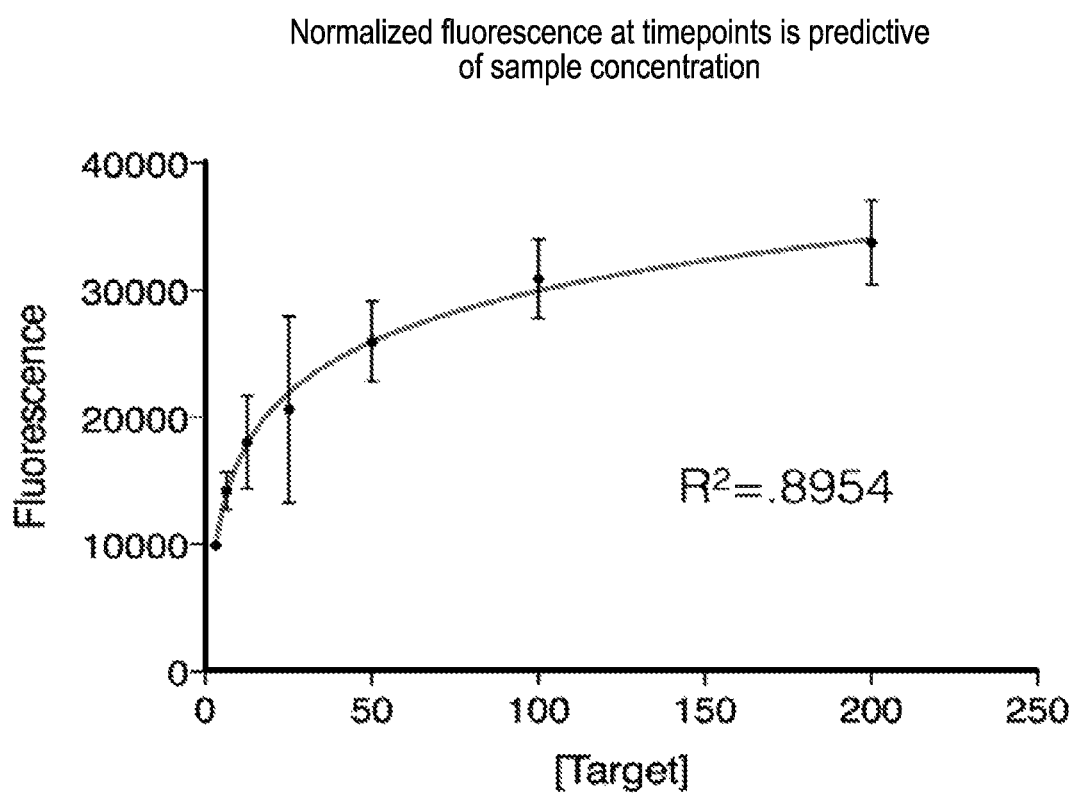
FIG. 15—shows that normalized fluorescence at particular time points is predictive of sample input concentration. Fluorescence measurements from Cas13a detection without amplification are correlated with input RNA concentration (n=2 biological replicates; bars represent mean±s.e.m.).
Figure 16:
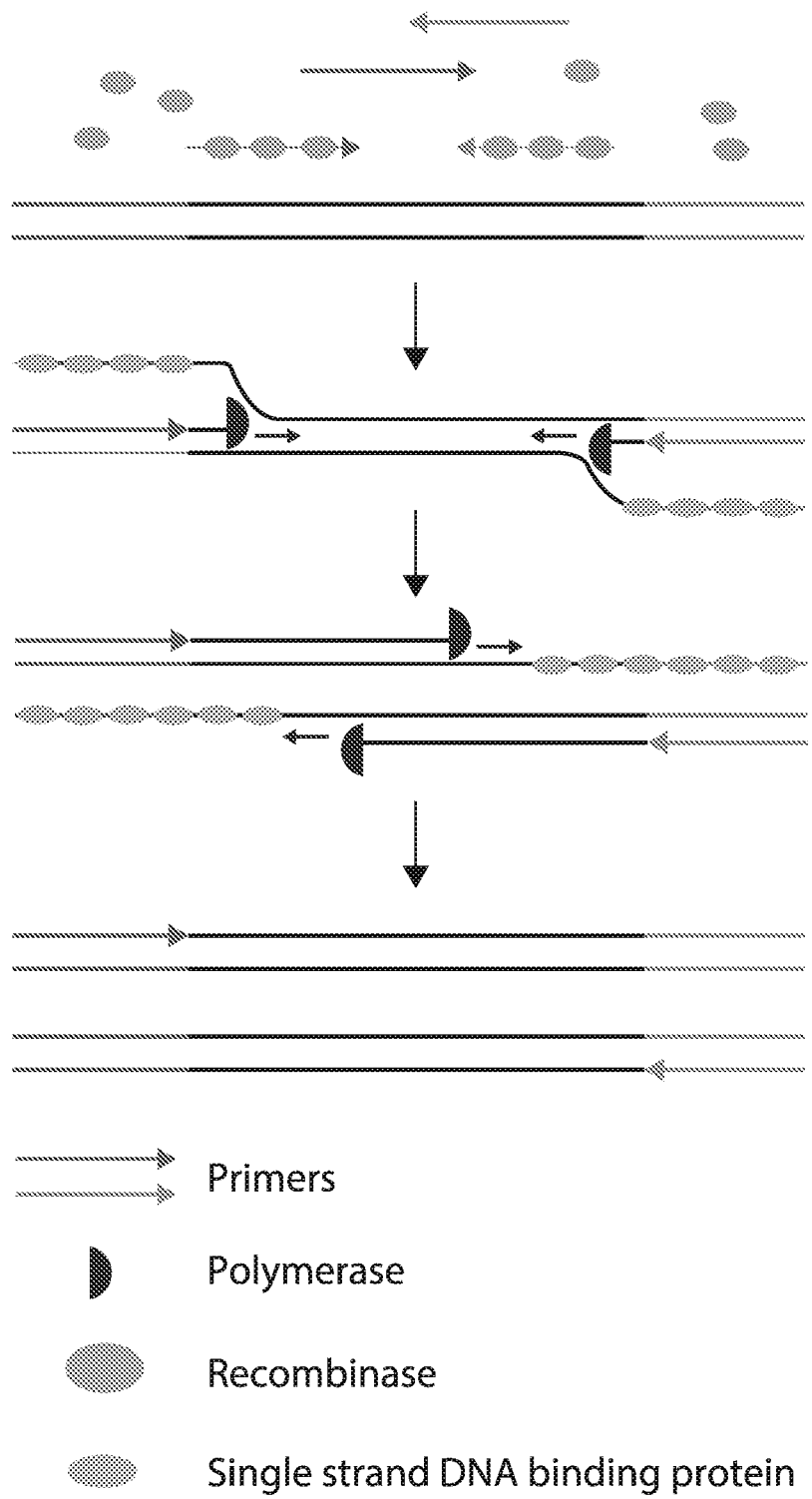
FIG. 16—provides a schematic of the RPA reaction, showing the participating components in the reaction.

Additionally, RPA has a number of limitations:

1) Although Cas13a detection is quantitative (FIG. 15), real-time RPA quantitation can be difficult because of its rapid saturation when the recombinase uses all available ATP. While real-time PCR is quantitative because of the ability to cycle amplification, RPA has no mechanism to tightly control the rate of amplification. Certain adjustments can be made to reduce amplification speed, such as reducing available magnesium or primer concentrations, lowering the reaction temperature, or designing inefficient primers. Although we see some instances of quantitative SHERLOCK, such as in FIGS. 31, 32, and 52, it is not always the case and depends on the template.

2) RPA efficiency can be sensitive to primer design. The manufacturer typically recommends designing longer primers to ensure efficient recombinase binding with average GC content (40-60%) and screening up to 100 primer pairs to find highly sensitive primer pairs. We have found with SHERLOCK that we only have to design two primer pairs to achieve an atomolar test with single molecule sensitivity. This robustness is likely due to the additional amplification of signal by constitutively active Cas13a collateral activity that off-sets any inefficiencies in amplicon amplification. This quality is particularly important for our bacterial pathogen identification in FIG. 34. Issues were experienced with amplifying highly structured regions such as the 16S rRNA gene sites in bacterial genomes because there is no melting step involved in RPA. Thus, secondary structure in primers becomes an issue, limiting amplification efficiency and thus sensitivity. The embodiments disclosed herein were believed to be successful despite these RPA-specific issues because of additional signal amplification from Cas13a.

3) The amplification sequence length must be short (100-200 bp) for efficient RPA. For most applications, this is not a significant issue and perhaps is even advantageous (e.g., cfDNA detection where average fragment size is 160 bp). Sometimes large amplicon lengths are important, such as when universal primers are desired for bacterial detection and the SNPs for discrimination are spread over a large area.

Figure 10:
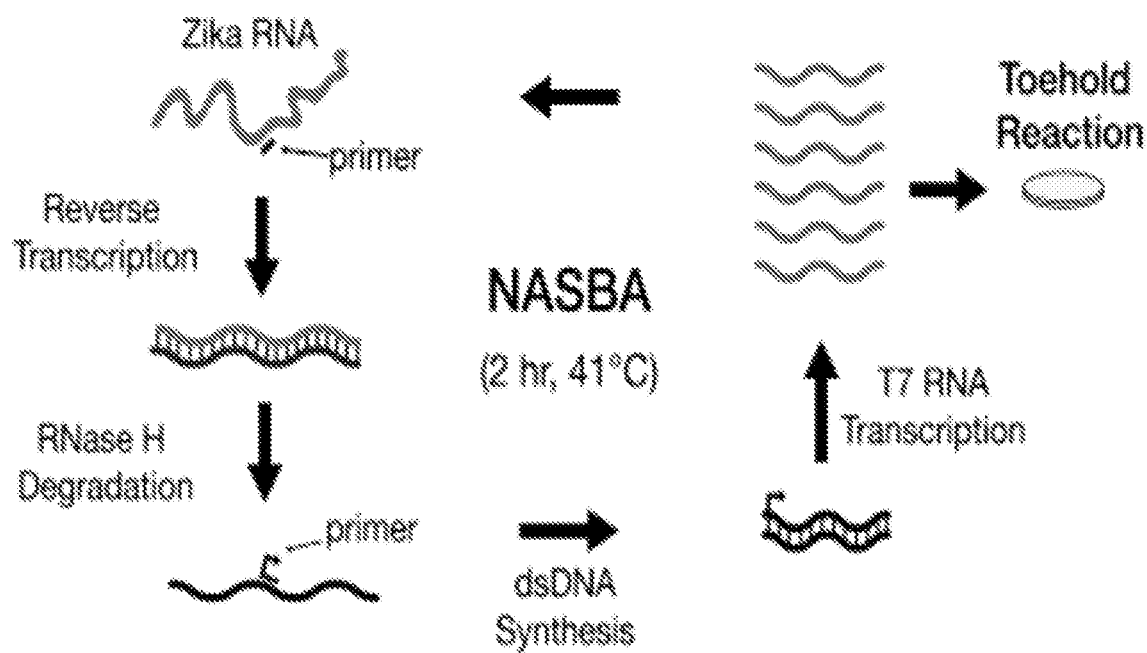
FIG. 10—is a schematic showing the general steps of a NASBA amplification reaction.
Figure 11:
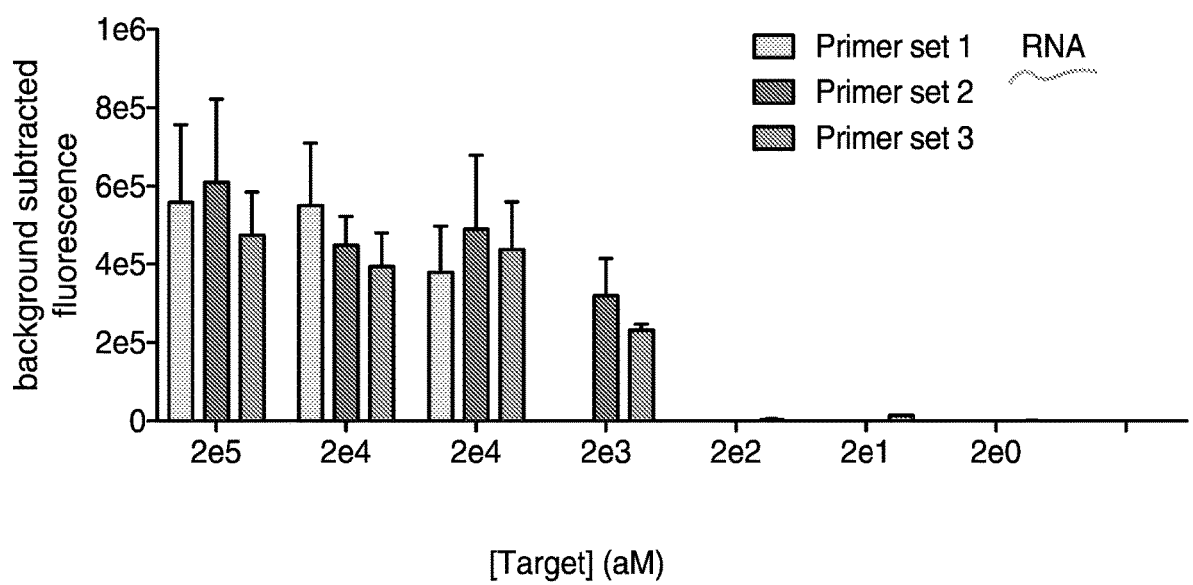
FIG. 11—provides a graph showing detection of nucleic acid target ssRNA 1 amplified by NASBA with three different primer sets and then subjected to C2c2 collateral detection using a quenched fluorescent probe (n=2 technical replicates; bars represent mean s.e.m.).
Figure 12:
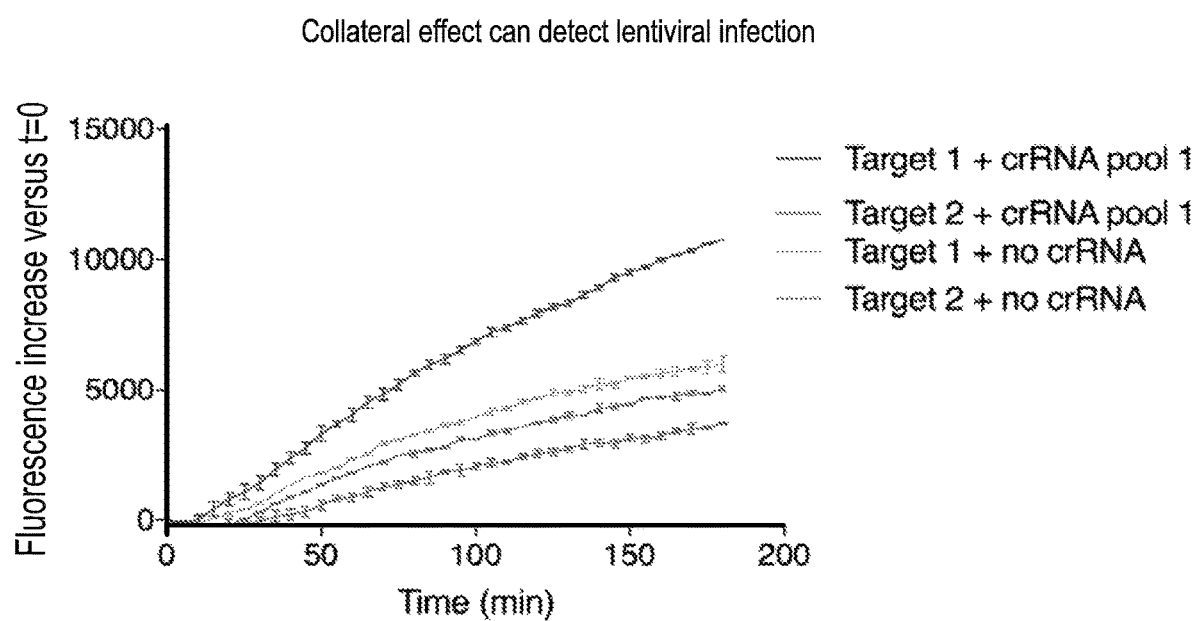
FIG. 12—provides a graph showing that the collateral effect may be used to detect the presence of a lentiviral target RNA.
Figure 13:
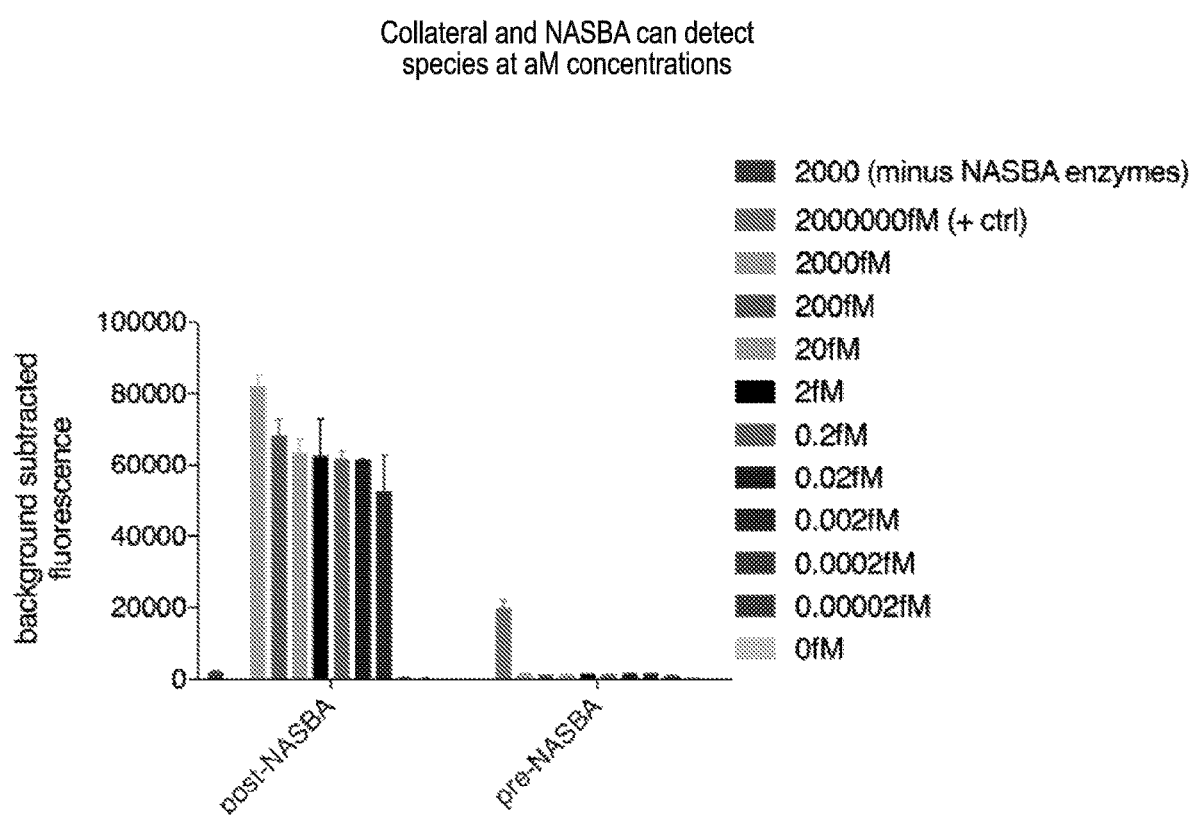
FIG. 13—provides a graph demonstrating that the collateral effect and NASBA can detect species at aM concentrations.
Figure 14:
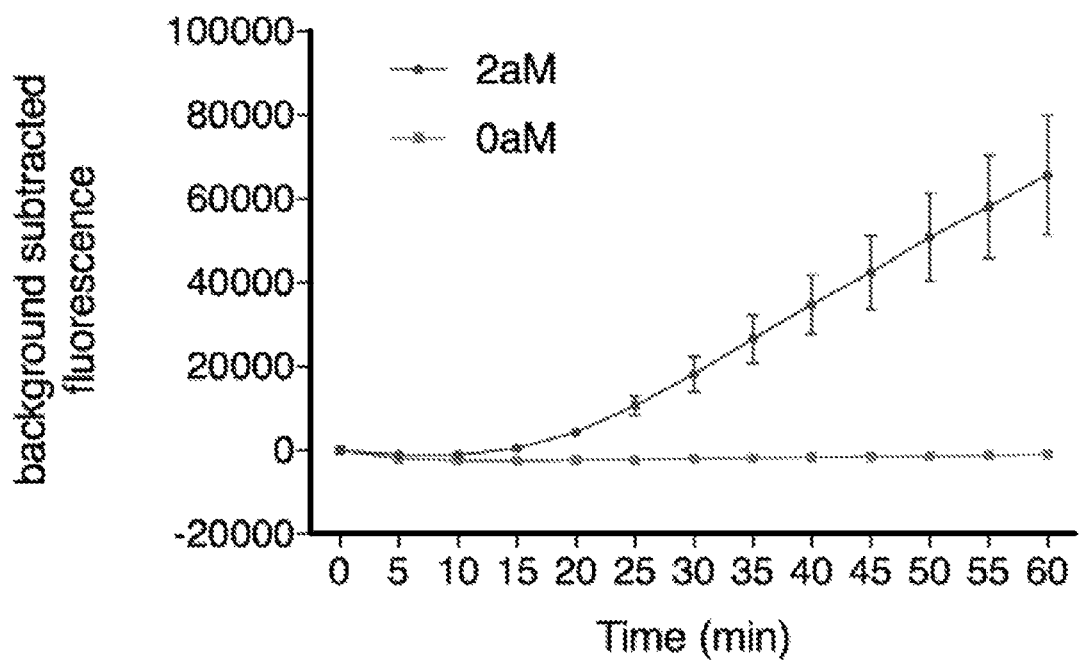
FIG. 14—provides a graph demonstrating that the collateral effect and NASBA quickly discriminate low concentration samples.
Figure 53:
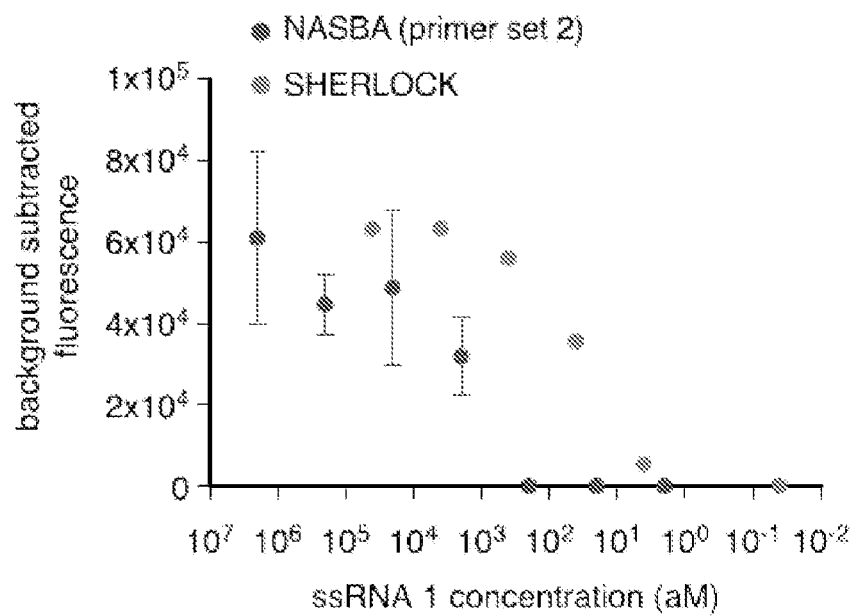
FIG. 53—Comparison of detection of ssRNA 1 by NASBA with primer set 2 (of FIG. 11) and SHERLOCK. (n=2 technical replicates; bars represent mean±s.e.m.).

SHERLOCK's modularity allows any amplification technique, even non-isothermal approaches, to be used prior to T7 transcription and Cas13a detection. This modularity is enabled by the compatibility of the T7 and Cas13a steps in a single reaction allowing detection to be performed on any amplified DNA input that has a T7 promoter. Prior to using RPA, nucleic acid sequence-based amplification (NASBA) (3, 4) was attempted for our detection assay (FIG. 10). However, NASBA did not drastically improve the sensitivity of Cas13a (FIGS. 11 and 53). Other amplification techniques that could be employed prior to detection include PCR, loop mediated isothermal amplification (LAMP) (5), strand displacement amplification (SDA) (6), helicase-dependent amplification (HDA) (7), and nicking enzyme amplification reaction (NEAR) (8). The ability to swap any isothermal technique allows SHERLOCK to overcome the specific limitations of any one amplification technique.

Design of Engineered Mismatches.

Figure 36:
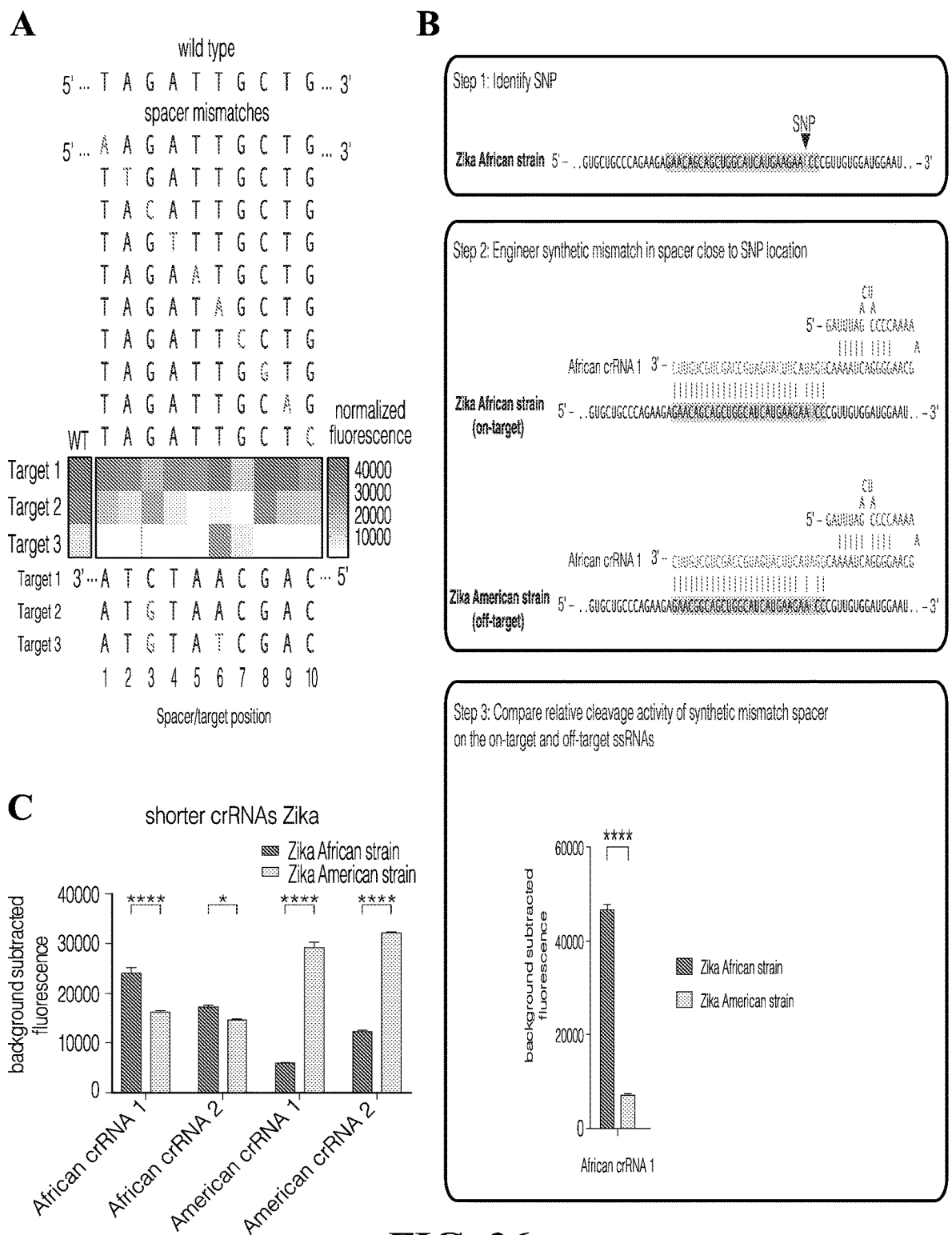
FIG. 36—provides a set of graphs demonstrating that (A) C2c2 is not sensitive to single mismatches but can distinguish between single nucleotide differences in target when loaded with crRNAs with additional mismatches. ssRNA targets 1-3 were detected with 11 crRNAs, with 10 spacers containing synthetic mismatches at various positions in the crRNA. Mismatched spacers did not show reduced cleavage of target 1 but showed inhibited cleavage of mismatch targets 2 and 3 (SEQ ID NOS: 146 through 159). (B) Schematic showing the process for rational design of single-base specific spacers with synthetic mismatches. Synthetic mismatches are placed in proximity to the SNP or base of interest. (SEQ ID NOS:160 through 164) (C) Highly specific detection of strain SNPs allows for the differentiation of Zika African versus American RNA targets differing by only one nucleotide using C2c2 detection with truncated (23 nucleotide) crRNAs (n=2 technical replicates, one-tailed Student t-test;*, p<0.05;****, p<0.0001; bars represent mean±s.e.m.).

We previously showed that LshCas13a target cleavage was reduced when there were two or more mismatches in the target:crRNA duplex but was relatively unaffected by single mismatches, an observation we confirmed for LwCas13a collateral cleavage (FIG. 36A). We hypothesized that by introducing an additional mutation in the crRNA spacer sequence, we would destabilize collateral cleavage against a target with an additional mismatch (two mismatches in total) while retaining on-target collateral cleavage, as there would only be a single mismatch. To test the possibility of engineering increased specificity, we designed multiple crRNAs targeting ssRNA 1 and included mismatches across the length of the crRNA (FIG. 36A) to optimize on-target collateral cleavage and minimize collateral cleavage of a target that differs by a single mismatch. We observed that these mismatches did not reduce collateral cleavage of ssRNA 1, but significantly decreased signal for a target that included an additional mismatch (ssRNA 2). The designed crRNA that best distinguished between ssRNA 1 and 2 included synthetic mismatches close to the ssRNA 2 mismatch, in effect creating a "bubble," or distortion in the hybridized RNA. The loss of sensitivity caused by the coordination of a synthetic mismatch and an additional mismatch present in the target (i.e., a double mismatch) agrees with the sensitivity of LshCas13a and LwCas13a to consecutive or nearby double mismatches and presents a basis for rational design of crRNAs that enable single-nucleotide distinction (FIG. 36B).

For mismatch detection of ZIKV and DENV strains, our full-length crRNA contained two mismatches (FIG. 37A,B). Due to high sequence divergence between strains, we were unable to find a continuous stretch of 28 nt with only a single nucleotide difference between the two genomes. However, we predicted that shorter crRNAs would still be functional, and designed shorter 23 nt crRNAs against targets in the two ZTKV strains that included a synthetic mismatch in the spacer sequence and only one mismatch in the target sequence. These crRNAs could still distinguish African and American strains of ZTKV (FIG. 36C). Subsequent testing of 23 nt and 20 nt crRNA show that reductions of spacer length reduce activity but maintain or enhance the ability to discriminate single mismatches (FIG. 57A-G). To better understand how synthetic mismatches may be introduced to facilitate single-nucleotide mutation discrimination, we tiled the synthetic mismatch across the first seven positions of the spacer at three different spacer lengths: 28, 23, and 20 nt (FIG. 57A). On a target with a mutation at the third position, LwCas13a shows maximal specificity when the synthetic mismatch is in position 5 of the spacer, with improved specificity at shorter spacer lengths, albeit with lower levels of on-target activity (FIG. 57B-G). We also shifted the target mutation across positions 3-6 and tiled synthetic mismatches in the spacer around the mutation (FIG. 58).

Genotyping with SHERLOCK Using Synthetic Standards.

Evaluation of synthetic standards created from PCR amplification of the SNP loci allows for accurate identification of genotypes (FIG. 60A,B). By computing all comparisons (ANOVA) between the SHERLOCK results of an individual's sample and the synthetic standards, each individual's genotype can be identified by finding the synthetic standard that has the most similar SHERLOCK detection intensity (FIG. 60C,D). This SHERLOCK genotyping approach is generalizable to any SNP locus (FIG. 60E).

SHERLOCK is an Affordable, Adaptable CRISPR-Dx Platform.

For the cost analysis of SHERLOCK, reagents determined to be of negligible cost were omitted, including DNA templates for the synthesis of crRNA, primers used in RPA, common buffers (MgCl2, Tris HCl, glycerol, NaCl, DTT), glass microfiber filter paper, and RNAsecure reagent. For DNA templates, ultramer synthesis from IDT provides material for 40 in vitro transcription reactions (each being enough for ~10,000 reactions) for ~$70, adding negligible cost to crRNA synthesis. For RPA primers, a 25 nmole IDT synthesis of a 30 nt DNA primer can be purchased for ~$10, providing material adequate for 5000 SHERLOCK reactions. Glass microfiber paper is available for $0.50/sheet, which is sufficient for several hundred SHERLOCK reactions. 4% RNAsecure reagent costs $7.20/mL, which is sufficient for 500 tests.

In addition, for all experiments, except the paper-based assays, 384-well plates were used (Corning 3544), at the cost of $0.036/reaction. Because of the negligible cost, this was not included in the overall cost analysis. Additionally, SHERLOCK-POC does not require the use of a plastic vessel, as it can easily be performed on paper. The readout method for SHERLOCK used herein was a plate reader equipped with either a filter set or a monochromator. As a capital investment, the cost of the reader was not included in the calculation, as the cost precipitously decreases as more reactions are run on the instrument and is negligible. For POC applications, cheaper and portable alternatives could be used, such as hand-held spectrophotometers (9) or portable electronic readers (4), which reduce the cost of instrumentation to <$200. While these more portable solutions will reduce the speed and ease of readout as compared to bulkier instruments, they allow for more broad use.

Results

The assay and systems described herein may generally comprise a two-step process of amplification and detection. During the first step, the nucleic acid sample, either RNA or DNA, is amplified, for example by isothermal amplification. During the second step, the amplified DNA is transcribed into RNA and subsequently incubated with a CRISPR effector, such as C2c2, and a crRNA programmed to detect the presence of the target nucleic acid sequence. To enable detection, a reporter RNA that has been labeled with a quenched fluorophore is added to the reaction. Collateral cleavage of the reporter RNA results in un-quenching of the fluorophore and allows for real-time detection of the nucleic acid target (FIG. 17).

To achieve robust signal detection, an ortholog of C2c2 was identified from the organism Leptotrichia wadei (LwC2c2) and evaluated. The activity of the LwC2c2 protein was evaluated by expressing it along with a synthetic CRISPR array in E. coli and programming it to cleave a target site within the beta-lactamase mRNA, which leads to death of the bacteria under ampicillin selection (FIG. 2B). Fewer surviving E. coli colonies were observed with the LwC2c2 locus than with the LshC2c2 locus, demonstrating a higher cleavage activity of the LwC2c2 ortholog (FIG. 2C). The human-codon optimized LwC2c2 protein was then purified from E. coli (FIG. 2D-E) and its ability to cleave a 173-nt ssRNA assayed with different protospacer flanking site (PFS) nucleotides (FIG. 2F). LwC2c2 was able to cleave each of the possible four PFS targets, with slightly less activity on the ssRNA with a G PFS.

Figure 18:
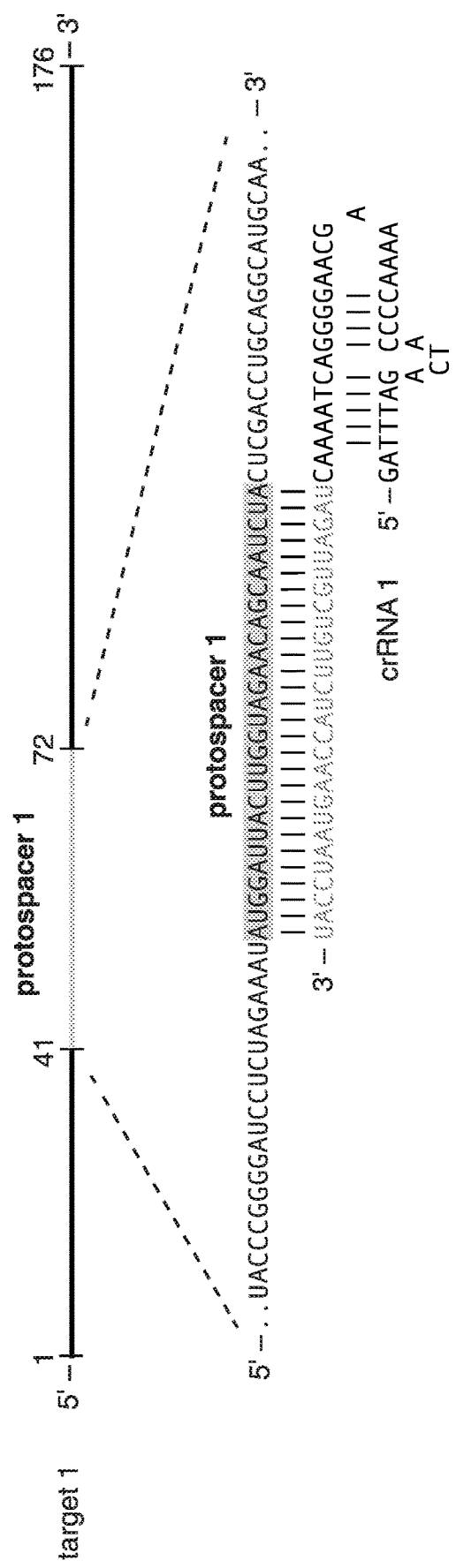
FIG. 18—provides a schematic of ssRNA target detected via the C2c2 collateral detection (SEQ ID NOS: 144 and 145).
Figure 19:
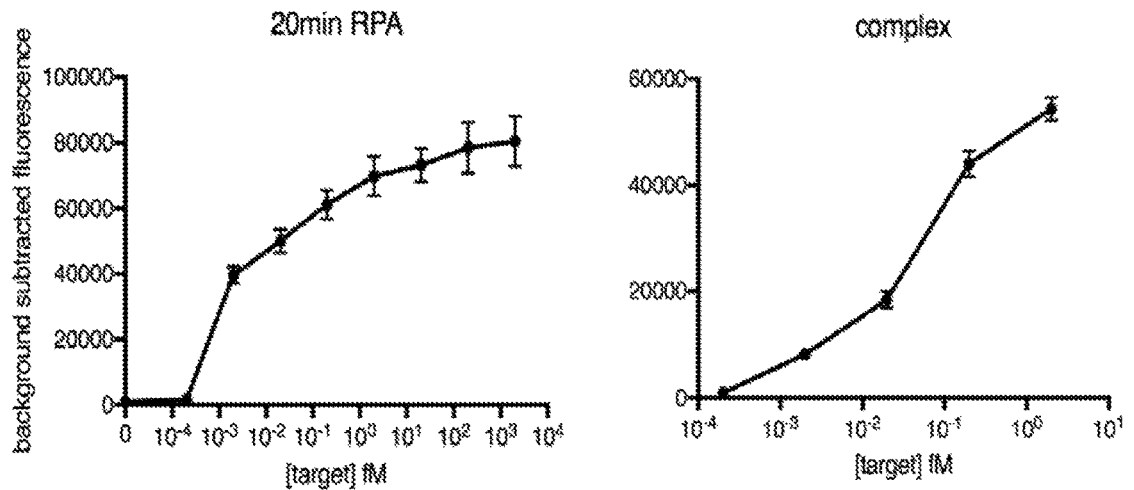
FIG. 19—provides a set of graphs demonstrating single molecule DNA detection using RPA (i.e., within 15 minutes of C2c2 addition).
Figure 20:
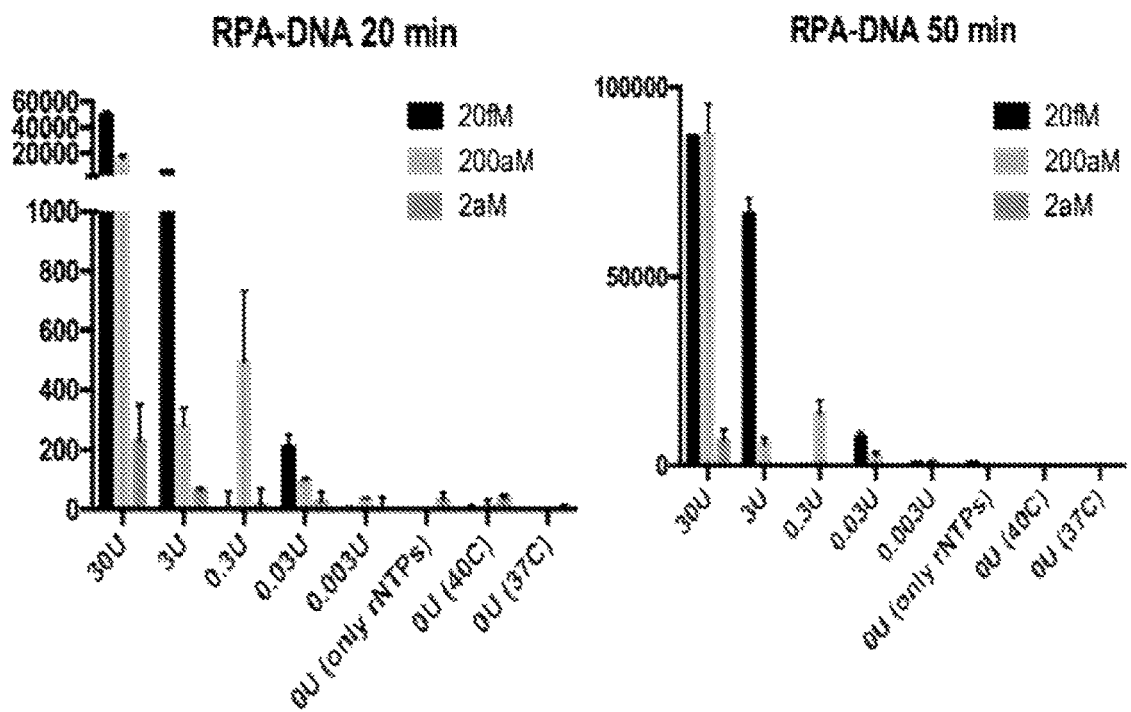
FIG. 20—provides a set of graphs demonstrating that mixing T7 polymerase into an RPA reaction does adversely affect DNA detection.
Figure 21:
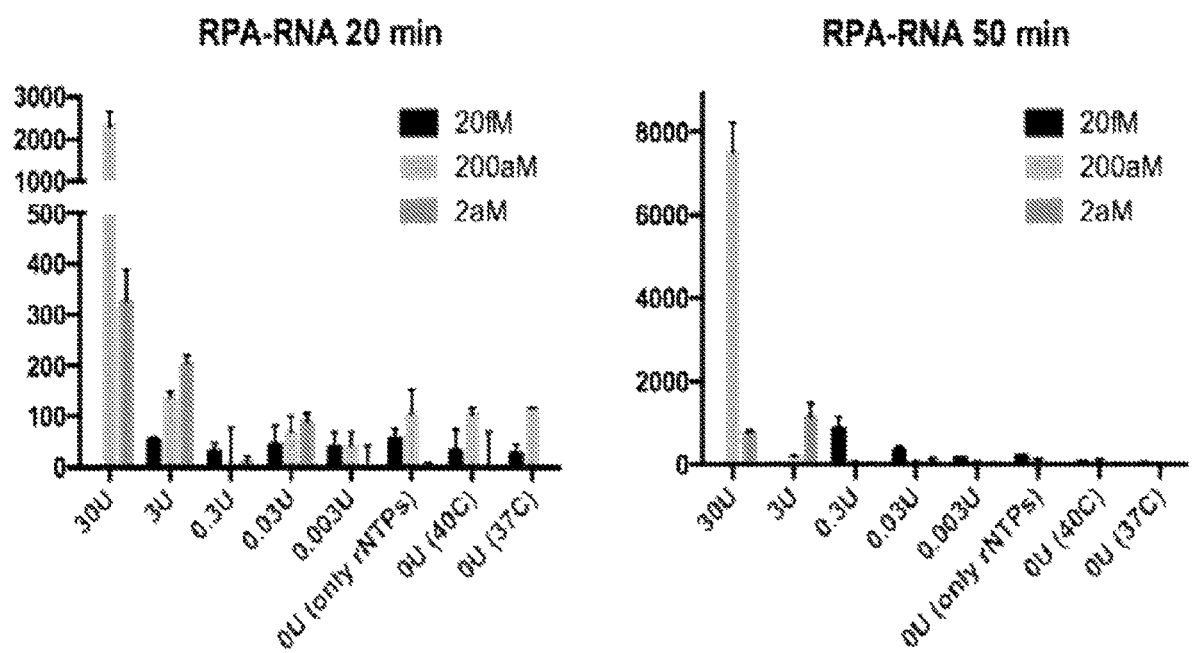
FIG. 21—provides a set of graphs demonstrating that mixing polymerase into an RPA reaction does not adversely affect DNA detection.

Real-time measurement of LwC2c2 RNase collateral activity was measured using a commercially available RNA fluorescent plate reader. To determine the baseline sensitivity of LwC2c2 activity, LwC2c2 was incubated with ssRNA target 1 (ssRNA 1) and a crRNA that is complementary to a site within the ssRNA target, along with the RNA sensor probe (FIG. 18). This yielded a sensitivity of ~50 fM (FIG. 27A), which, although more sensitive than other recent nucleic acid detection technologies (Pardee et al., 2014), is not sensitive enough for many diagnostic applications which require sub-femtomolar detection performance (Barletta et al., 2004; Emmadi et al., 2011; Rissin et al., 2010; Song et al., 2013).

To increase sensitivity, an isothermal amplification step was added prior to incubation with LwC2c2. Coupling LwC2c2-mediated detection with previously used isothermal amplification approaches such as nucleic acid sequence-based amplification (NASBA)(Compton, 1991; Pardee et al., 2016) improved sensitivity to a certain extent (FIG. 11). An alternative isothermal amplification approach, recombinase polymerase amplification (RPA) (Piepenburg et al., 2006), was tested which can be used to amplify DNA exponentially in under two hours. By adding a T7 RNA polymerase promoter onto the RPA primers, amplified DNA can be converted to RNA for subsequent detection by LwC2c2 (FIG. 17). Thus, in certain example embodiments, the assay comprises the combination of amplification by RPA, T7 RNA polymerase conversion of DNA to RNA, and subsequent detection of the RNA by C2c2 unlocking of fluorescence from a quenched reporter.

Figure 22:
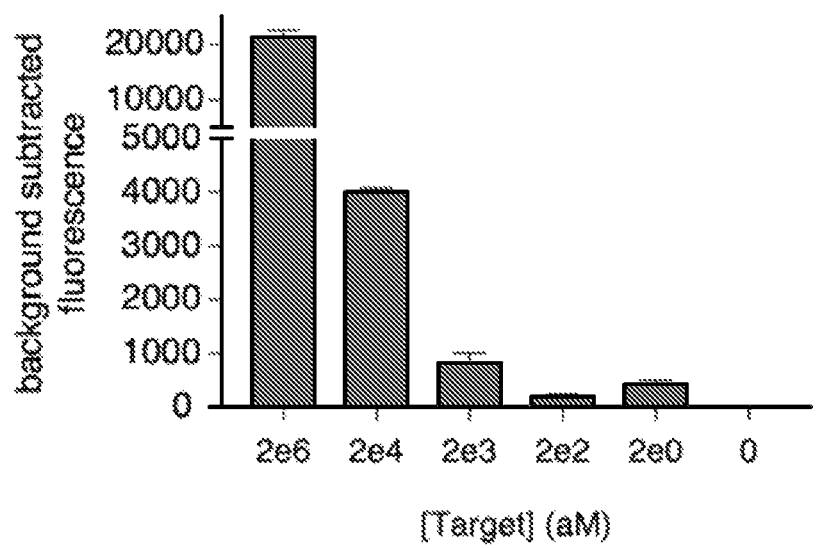
FIG. 22—provides a graph demonstrating that RPA, T7 transcription, and C2c2 detection reactions are compatible and achieve single molecule detection when incubated simultaneously (n=2 technical replicates; bars represent mean±s.e.m.).
Figure 23:
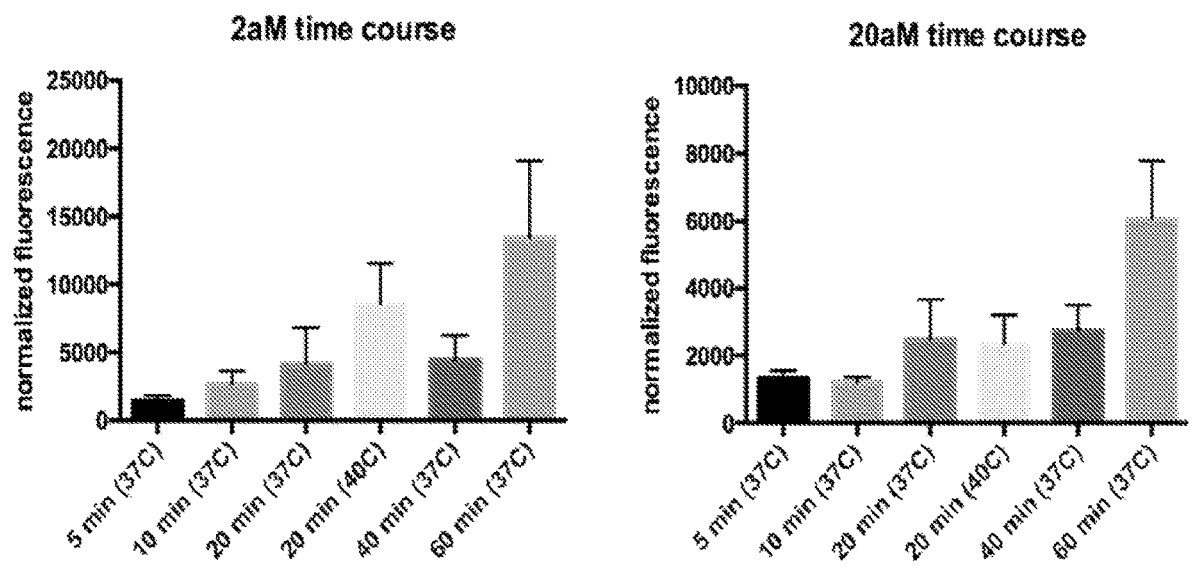
FIG. 23—provides a set of graphs demonstrating the efficacy of quick RPA-RNA time incubations.
Figure 24:
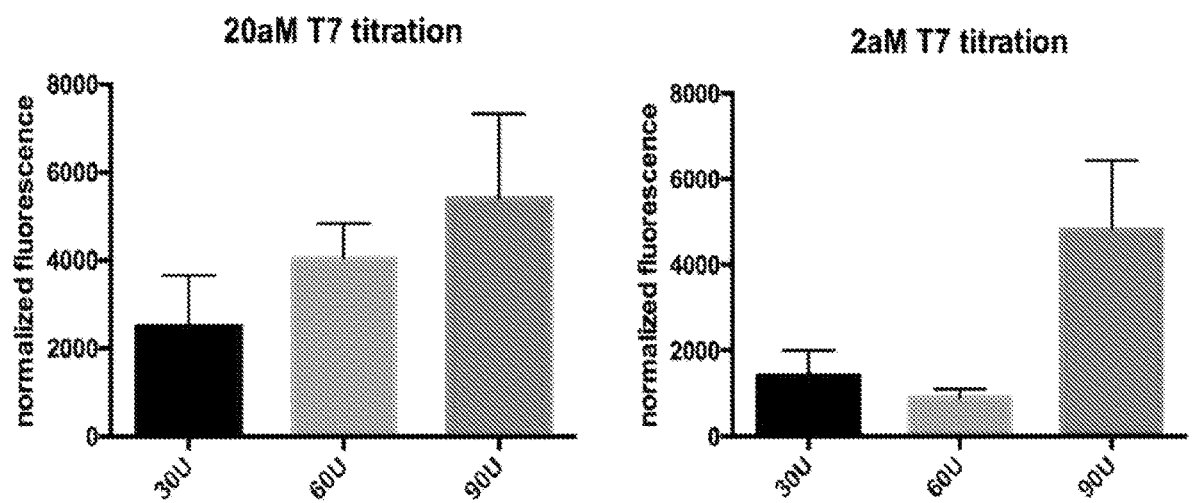
FIG. 24—provides a set of graphs demonstrating that increasing T7 polymerase amount boosts sensitivity for RPA-RNA.
Figure 25:
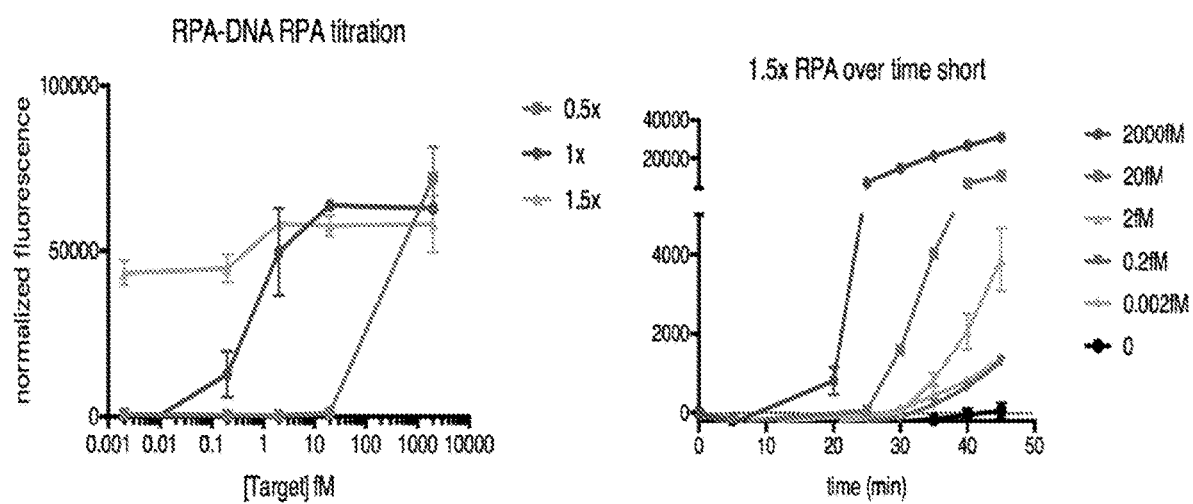
FIG. 25—provides a set of graphs showing results from an RPA-DNA detection assay using a one-pot reaction with 1.5× enzymes. Single molecule (2aM) detection achieved as early as 30 minutes.
Figure 26:
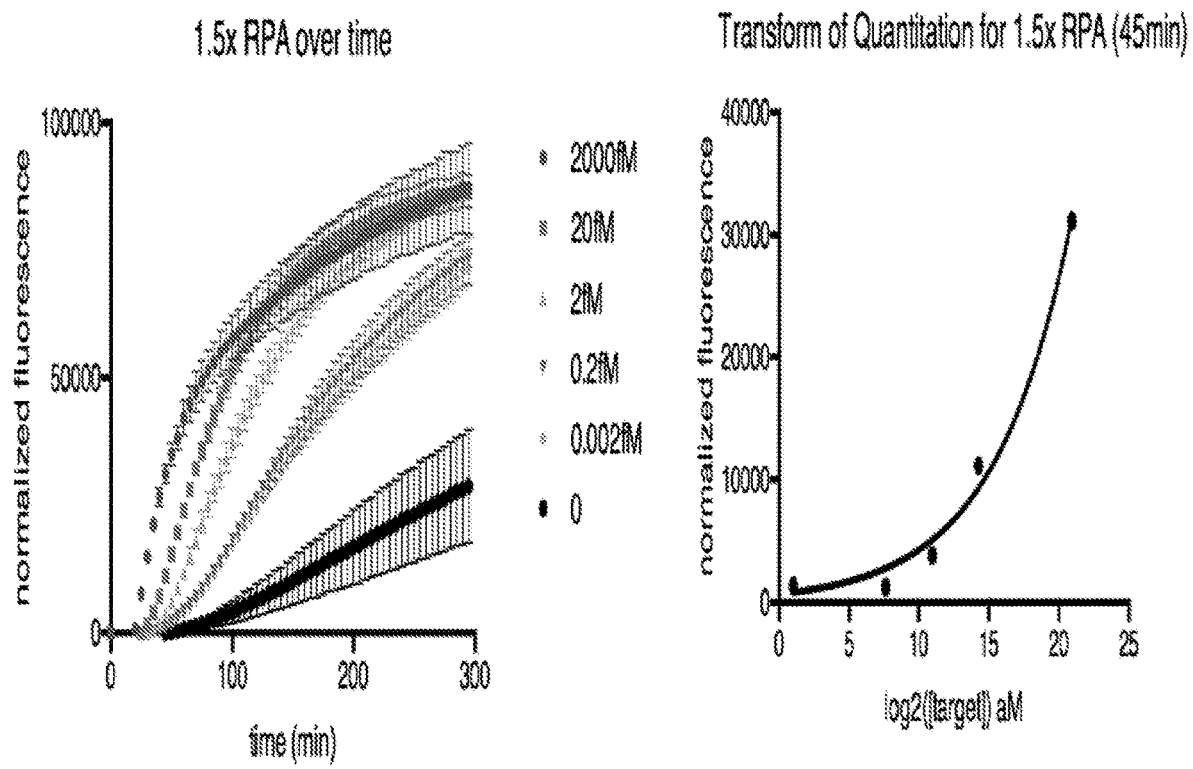
FIG. 26—provides a set of graphs demonstrating that an RPA-DNA one-pot reaction demonstrates a quantitative decrease in fluorescence relative to input concentration. The fitted curve reveals relationship between target input concentration and output fluorescence.

Using the example method on a synthesized DNA version of ssRNA 1, it was possible to achieve attomolar sensitivity in the range of 1-10 molecules per reaction (FIG. 27B, left). In order to verify the accuracy of detection, the concentration of input DNA was qualified with digital-droplet PCR and confirmed that the lowest detectable target concentration (2 aM) was at a concentration of a single molecule per microliter. With the addition of a reverse transcription step, RPA can also amplify RNA into a dsDNA form, allowing us attomolar sensitivity on ssRNA 1 to be achieved (27B, right). Similarly, the concentrations of RNA targets were confirmed by digital-droplet PCR. To evaluate the viability of the example method to function as a POC diagnostic test, the ability of all components—RPA, T7 polymerase amplification, and LwC2c2 detection—to function in a single reaction were tested and found attomolar sensitivity with a one-pot version of the assay (FIG. 22).

The Assay is Capable of Sensitive Viral Detection in Liquid or on Paper

Figure 33:
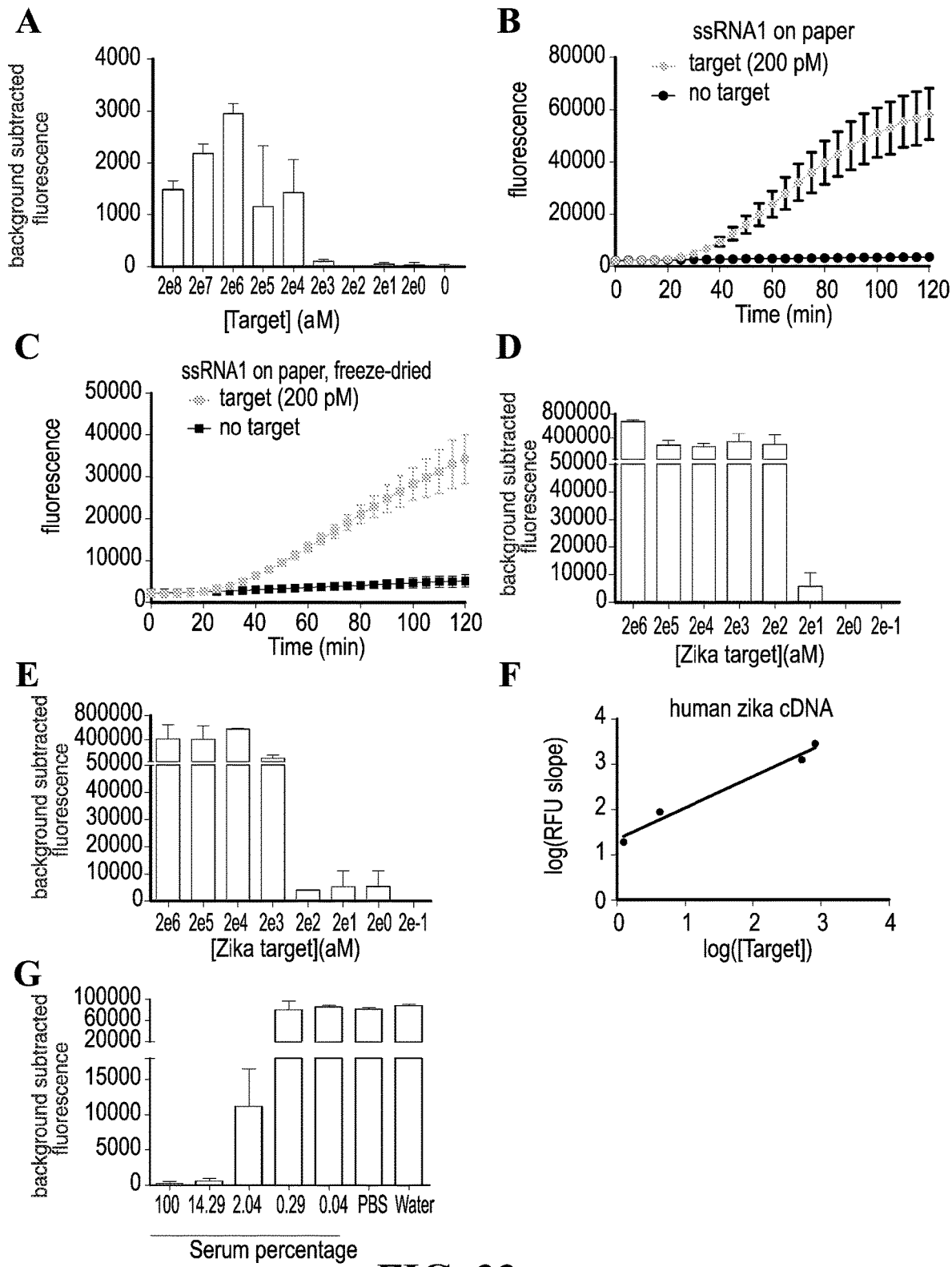
FIG. 33—provides a set of graphs demonstrating (A) freeze-dried C2c2 is capable of sensitive detection of ssRNA 1 in the low femtomolar range. C2c2 is capable of rapid detection of a 200 pM ssRNA 1 target on paper in liquid form (B) or freeze dried (C). The reaction is capable of sensitive detection of synthesized Zika RNA fragments in solution (D) (n=3) and in freeze-dried form (E) (n=3). (F) Quantitative curve for human zika cDNA detection showing significant correlation between input concentration and detected fluorescence. (G) C2c2 detection of ssRNA 1 performed in the presence of varying amounts of human serum (n=2 technical replicates, unless otherwise noted; bars represent mean±s.e.m.).

It was next determined whether the assay would be effective in infectious disease applications that require high sensitivity and could benefit from a portable diagnostic. To test detection in a model system, lentiviruses harboring RNA fragments of the Zika virus genome and the related flavivirus Dengue (Dejnirattisai et al., 2016) were produced and the number of viral particles quantified (FIG. 31A). Levels of mock virus were detected down to 2 aM. At the same time, it was also possible to show clear discrimination between these proxy viruses containing Zika and Dengue RNA fragments (FIG. 31B). To determine whether the assay would be compatible with freeze-drying to remove dependence on cold chains for distribution, the reaction components were freeze-dried. After using the sample to rehydrate the lyophilized components, 20 fM of ssRNA 1 was detected (FIG. 33A). Because resource-poor and POC settings would benefit from a paper test for ease of usability, the activity of C2c2 detection on glass fiber paper was also evaluated and found that a paper-spotted C2c2 reaction was capable of target detection (FIG. 33B). In combination, freeze-drying and paper-spotting the C2c2 detection reaction resulted in sensitive detection of ssRNA 1 (FIG. 33C). Similar levels of sensitivity were also observed for detection of a synthetic Zika viral RNA fragment between LwC2c2 in solution and freeze-dried LwC2c2, demonstrating the robustness of freeze-dried SHERLOCK and the potential for a rapid, POC Zika virus diagnostic (FIG. 33D-E). Toward this end, the ability of the POC variant of the assay was tested to determine the ability to discriminate Zika RNA from Dengue RNA (FIG. 31C). While paper-spotting and lyophilization slightly reduced the absolute signal of the readout, the assay still significantly detected mock Zika virus at concentrations as low as 20 aM (FIG. 31D), compared to detection of mock virus with the Dengue control sequence.

Zika viral RNA levels in humans have been reported to be as low as $3\times10^6$ copies/mL (4.9 fM) in patient saliva and $7.2\times10^5$ copies/mL (1.2 fM) in patient serum (Barzon et al., 2016; Gourinat et al., 2015; Lanciotti et al., 2008). From obtained patient samples, concentrations as low as $1.25\times10^3$ copies/mL (2.1 aM) were observed. To evaluate whether the assay is capable of Zika virus detection of low-titer clinical isolates, viral RNA was extracted from patients and reverse transcribed and the resulting cDNA was used as input for the assay (FIG. 32A). Significant detection for the Zika human serum samples was observed at concentrations down to 1.25 copy/uL (2.1 aM) (FIG. 32B). Furthermore, signal from patient samples was predictive of Zika viral RNA copy number and could be used to predict viral load. To test broad applicability for disease situations where nucleic acid purification is unavailable, detection of ssRNA 1 spiked into human serum was tested, and it was determined that the assay was activated at serum levels below 2% (FIG. 33G).

Bacterial Pathogen Distinction and Gene Distinction

Figure 34:
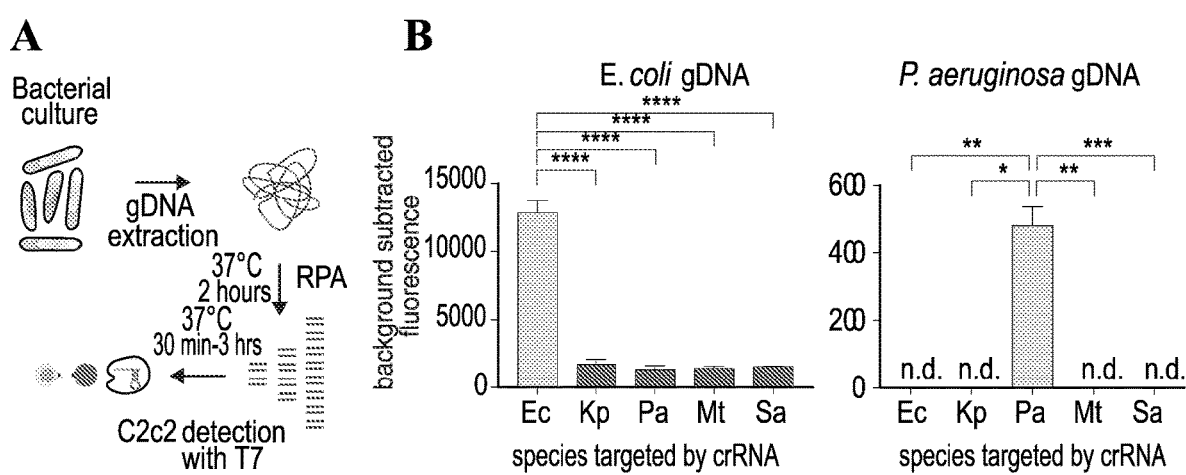
FIG. 34—provides (A) schematic of C2c2 detection of 16S rRNA gene from bacterial genomes using a universal V3 RPA primer set, and (B) the ability to achieve sensitive and specific detection of *E. coli* or *P. aeruginosa* gDNA using an assay conducted in accordance with certain example embodiments. (n=4 technical replicates, two-tailed Student t-test;****, p<0.0001; bars represent mean±s.e.m.). Ec, *Escherichia coli*; Kp, *Klebsiella pneumoniae*; Pa, *Pseudomonas aeruginosa*; Mt, *Mycobacterium tuberculosis*; Sa, *Staphylococcus aureus*.

To determine if the assay could be used to distinguish bacterial pathogens, the 16S V3 region was selected as an initial target, as the conserved flanking regions allow universal RPA primers to be used across bacterial species, and the variable internal region allowing for differentiation of species. A panel of 5 possible targeting crRNAs were designed for pathogenic strains and isolated E. coli and Pseudomonas aeruginosa gDNA (FIG. 34A). The assay was capable of distinguishing E. coli or P. aeruginosa gDNA and showed low background signal for crRNAs of other species (FIG. 34 A,B).

Figure 35:
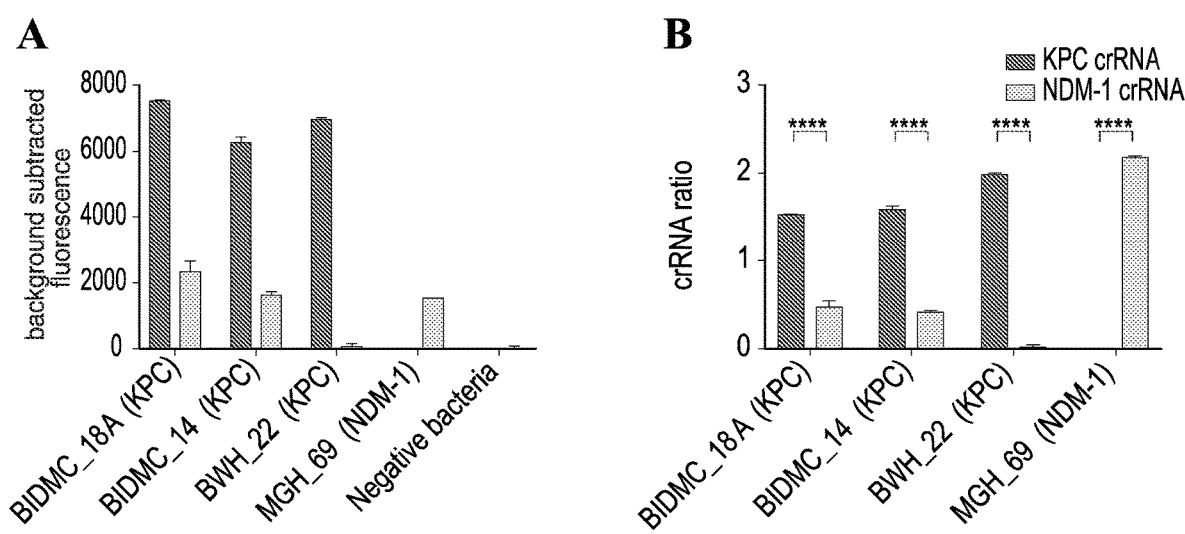
FIG. 35—provides a set of graphs demonstrating (A) detection of two different carbapenem-resistance genes (KPC and NDM-1) from four different clinical isolates of *Klebsiella pneumoniae*, and (B) detection of carbapenem-resistance genes (part A) is normalized as a ratio of signal between the KPC and NDM-1 crRNA assays (n=2 technical replicates, two-tailed Student t-test;****, p<0.0001; bars represent mean±s.e.m.).

The assay can also be adapted to rapidly detect and distinguish bacterial genes of interest, such as antibiotic-resistance genes. Carbapenem-resistant enterobacteria (CRE) are a significant emerging public health challenge (Gupta et al., 2011). The ability of the assay to detect carbapenem-resistance genes was evaluated, and if the test could distinguish between different carbapenem-resistance genes. Klebsiella pneumonia was obtained from clinical isolates harboring either Klebsiella pneumoniae carbapenemase (KPC) or New Delhi metallo-beta-lactamase 1 (NDM-1) resistance genes and designed crRNAs to distinguish between the genes. All CRE had significant signal over bacteria lacking these resistance genes (FIG. 35A) and that we could significantly distinguish between KPC and NDM-1 strains of resistance (FIG. 35B).

Single-Base Mismatch Specificity of CRISPR RNA-Guided RNases

It has been shown that certain CRISPR RNA-guided RNase orthologues, such as LshC2c2, do not readily distinguish single-base mismatches. (Abudayyeh et al., 2016). As demonstrated herein, LwC2c2 also shares this feature (FIG. 37A). To increase the specificity of LwC2c2 cleavage, a system for introducing synthetic mismatches in the crRNA:target duplex was developed that increases the total sensitivity to mismatches and enables single-base mismatch sensitivity. Multiple crRNAs for target 1 were designed and included mismatches across the length of the crRNA (FIG. 37A) to optimize on-target cleavage and minimize cleavage of a target that differs by a single mismatch. These mismatches did not reduce cleavage efficiency of ssRNA target 1, but significantly decreased signal for a target that included an additional mismatch (ssRNA target 2). The designed crRNA that best distinguished between targets 1 and 2 included synthetic mismatches close to the target 2 mismatch, in effect creating a "bubble." The loss of sensitivity caused by the coordination of a synthetic mismatch and an additional mismatch present in the target (i.e., a double mismatch) agrees with the sensitivity of LshC2c2 to consecutive or nearby double mismatches (Abudayyeh et al., 2016) and presents a format for rational design of crRNAs that enable single-nucleotide distinction (FIG. 37B).

Having demonstrated that C2c2 can be engineered to recognize single-base mismatches, it was determined whether this engineered specificity could be used to distinguish between closely related viral pathogens. Multiple crRNAs were designed to detect either the African or American strains of Zika virus (FIG. 37A) and either strain 1 or 3 of Dengue virus (FIG. 37C). These crRNAs included a synthetic mismatch in the spacer sequence, causing a single bubble to form when duplexed to the on-target strain due to the synthetic mismatch. However, when the synthetic mismatch spacer is duplexed to the off-target strain two bubbles form due to the synthetic mismatch and the SNP mismatch. The synthetic mismatch crRNAs detected their corresponding strains with significantly higher signal than the off-target strain allowing for robust strain distinction (FIG. 37B, 37D). Due to the significant sequence similarity between strains, it was not possible to find a continuous stretch of 28 nt with only a single nucleotide difference between the two genomes in order to demonstrate true single-nucleotide strain distinction. However, it was predicted that shorter crRNAs would still be functional, as they are with LshC2c2(Abudayyeh et al., 2016), and accordingly shorter 23-nt crRNAs were designed against targets in the two Zika strains that included a synthetic mismatch in the spacer sequence and only one mismatch in the target sequence. These crRNAs were still capable of distinguishing the African and American strains of Zika with high sensitivity (FIG. 36C).

Rapid Genotyping Using DNA Purified from Saliva

Rapid genotyping from human saliva could be useful in emergency pharmacogenomic situations or for at-home diagnostics. To demonstrate the potential of the embodiments disclosed herein for genotyping, five loci were chosen to benchmark C2c2 detection using 23andMe genotyping data as the gold standard (Eriksson et al., 2010) (FIG. 38A). The five loci span a broad range of functional associations, including sensitivity to drugs, such as statins or acetaminophen, norovirus susceptibility, and risk of heart disease (Table 15).

TABLE 15

SNP Variants tested

| ID | Gene | Category |
|---|---|---|
| rs5082 | APOA2 | Saturated fat consumption and weight gain |
| rs1467558 | CD44 | Acetaminophen metabolism |
| rs2952768 | near CREB1 | morphine dependence |
| rs4363657 | SLCO1B1 | 4.5x increase myopathy risk for statin users |
| rs601338 | FUT2 | resistance to norovirus |

Figure 40:
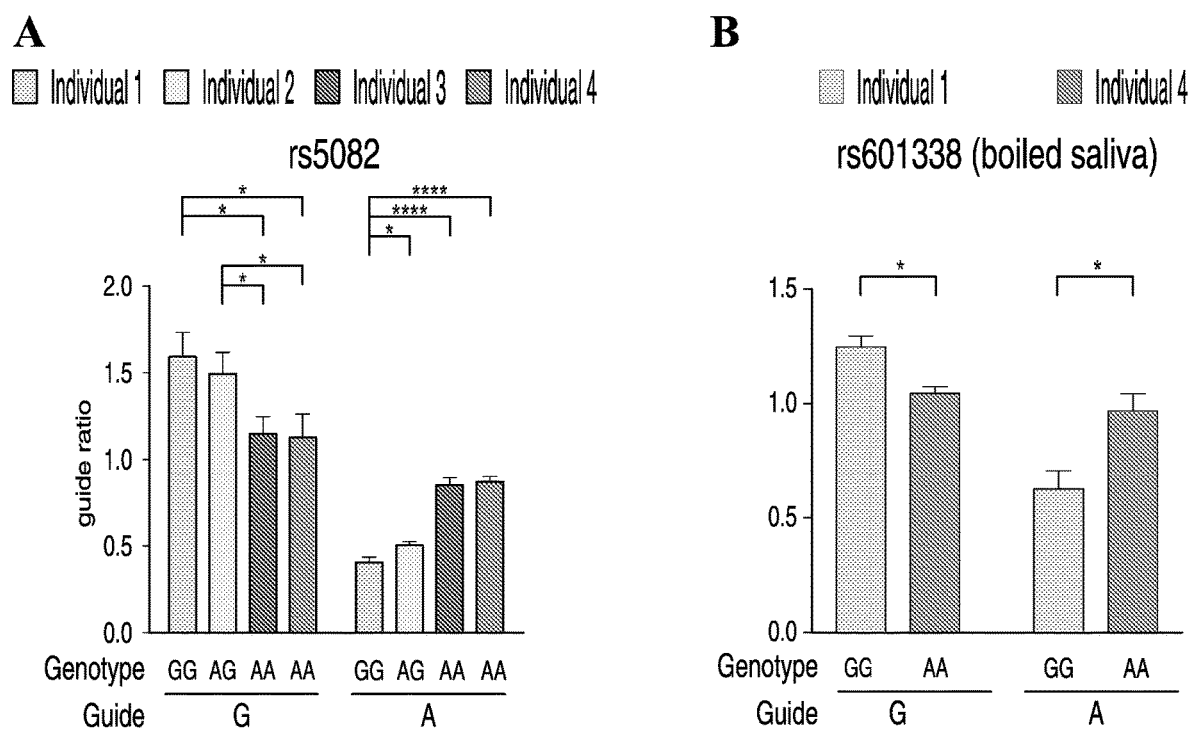
FIG. 40—provides a set of graphs demonstrating that (A) the assay can distinguish between genotypes at rs5082 (n=4 technical replicates; *, p<0.05; , p<0.01; *, p<0.001; ****, p<0.0001; bars represent mean±s.e.m.), (B) the assay can distinguish between genotypes at rs601338 in gDNA directly from centrifuged, denatured, and boiled saliva (n=3 technical replicates; *, p<0.05; bars represent mean±s.e.m.).

Saliva from four human subjects was collected and the genomic DNA purified using a simple commercial kit in less than an hour. The four subjects had a diverse set of genotypes across the five loci, providing a wide enough sample space for which to benchmark the assay for genotyping. For each of the five SNP loci, a subject's genomic DNA was amplified using RPA with the appropriate primers followed by detection with LwC2c2 and pairs of crRNAs designed to specifically detect one of the two possible alleles (FIG. 38B). The assay was specific enough to distinguish alleles with high significance and to infer both homozygous and heterozygous genotypes. Because a DNA extraction protocol was performed on the saliva prior to detection, the assay was tested to determine if it could be made even more amenable for POC genotyping by using saliva heated to 95° C. for 5 minutes without any further extraction. The assay was capable of correctly genotyping two patients whose saliva was only subjected to heating for 5 minutes and then subsequent amplification and C2c2 detection (FIG. 40B).

Detection of Cancerous Mutations in cfDNA at Low-Allelic Fractions

Because the assay is highly specific to single nucleotide differences in targets, a test was devised to determine if the assay was sensitive enough to detect cancer mutations in cell-free DNA (cfDNA). cfDNA fragments are small percentage (0.1% to 5%) of wild-type cfDNA fragments (Bettegowda et al., 2014; Newman et al., 2014; Olmedillas Lopez et al., 2016; Qin et al., 2016). A significant challenge in the cfDNA field is detecting these mutations because they are typically difficult to discover given the high levels of non-mutated DNA found in the background in blood (Bettegowda et al., 2014; Newman et al., 2014; Qin et al., 2016).

A POC cfDNA cancer test would also be useful for regular screening of cancer presence, especially for patients at risk for remission.

Figure 41:
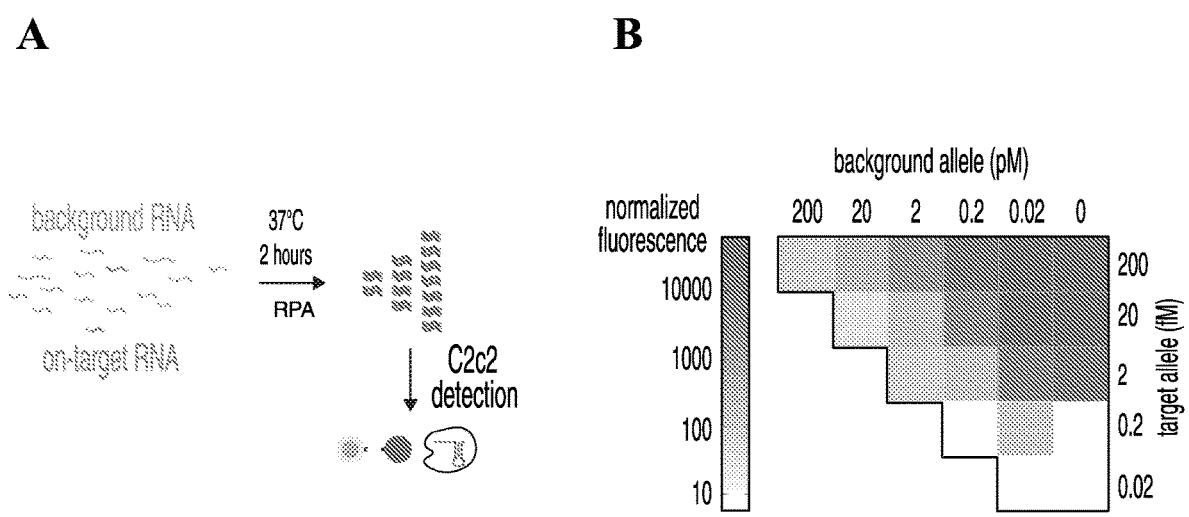
FIG. 41—provides (A) a schematic of an example embodiment performed on ssDNA 1 in the background of a target that differs from ssDNA 1 by only a single mismatch. (B) The assay achieves single nucleotide specificity detection of ssDNA 1 in the presence of mismatched background (target that differs by only a single mismatch from ssDNA). Various concentrations of target DNA were combined with a background excess of DNA with one mismatch and detected by the assay.
Figure 42:
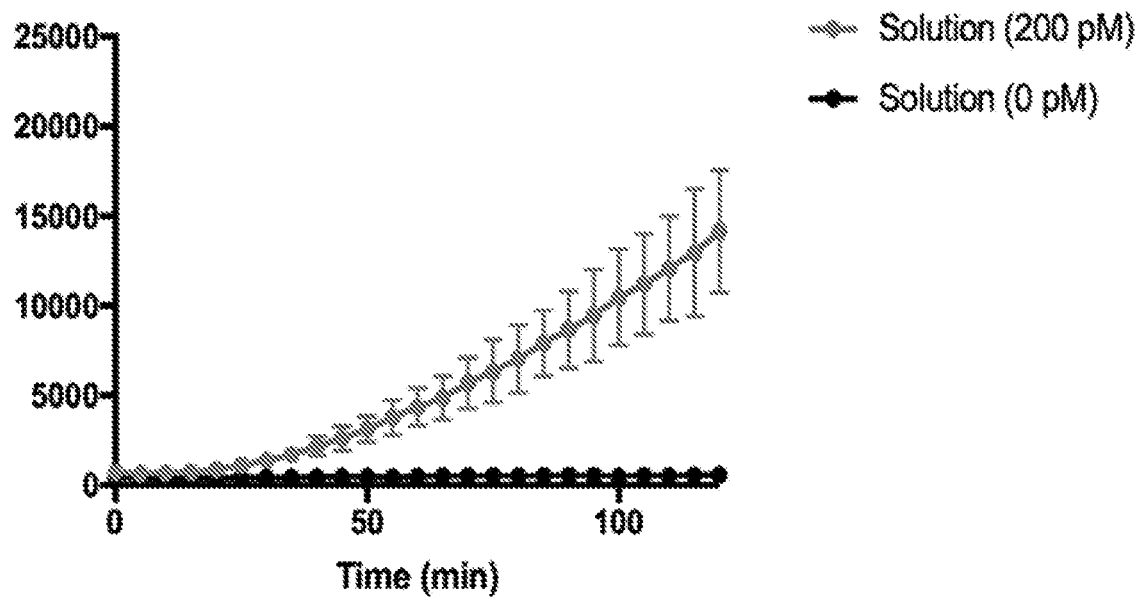
FIG. 42 is a graph showing a masking construct with a different dye Cy5 also allows for effective detection.

The assay's ability to detect mutant DNA in wild-type background was determined by diluting dsDNA target 1 in a background of ssDNA1 with a single mutation in the crRNA target site (FIG. 41A-B). LwC2c2 was capable of sensing dsDNA 1 to levels as low as 0.1% of the background dsDNA and within attomolar concentrations of dsDNA 1. This result shows that LwC2c2 cleavage of background mutant dsDNA 1 is low enough to allow robust detection of the on-target dsDNA at 0.1% allelic fraction. At levels lower than 0.1%, background activity is likely an issue, preventing any further significant detection of the correct target.

Because the assay could sense synthetic targets with allelic fractions in a clinically relevant range, it was evaluated whether the assay was capable of detecting cancer mutations in cfDNA. RPA primers to two different cancer mutations, EGFR L858R and BRAF V600E, were designed and commercial cfDNA standards were used with allelic fractions of 5%, 1%, and 0.1% that resemble actual human cfDNA samples to test. Using a pair of crRNAs that could distinguish the mutant allele from the wild-type allele (FIG. 38C), detection of the 0.1% allelic fraction for both of the mutant loci was achieved (FIG. 39 A-B).

Discussion

By combining the natural properties of C2c2 with isothermal amplification and a quenched fluorescent probe, the assay and systems disclosed herein have been demonstrated as a versatile, robust method to detect RNA and DNA, and suitable for a variety of rapid diagnoses including infectious disease applications and rapid genotyping. A major advantage of the assays and systems disclosed herein is that a new POC test can be redesigned and synthesized in a matter of days for as low as $0.6/test.

Because many human disease applications require the ability to detect single mismatches a rational approach was developed to engineer crRNAs to be highly specific to a single mismatch in the target sequence by introducing a synthetic mismatch in the spacer sequence of the crRNA. Other approaches for achieving specificity with CRISPR effectors rely on screening-based methods over dozens of guide designs (Chavez et al., 2016). Using designed mismatch crRNAs, discrimination of Zika and Dengue viral strains in sites that differ by a single mismatch, rapid genotyping of SNPs from human saliva gDNA, and detection of cancer mutations in cfDNA samples, was demonstrated.

The low cost and adaptability of the assay platform lends itself to further applications including (i) general RNA/DNA quantitation experience in substitute of specific qPCR assays, such as Taqman, (ii) rapid, multiplexed RNA expression detection resembling microarrays, and (iii) other sensitive detection applications, such as detection of nucleic acid contamination from other sources in food. Additionally, C2c2 could potentially be used for detection of transcripts within biological settings, such as in cells, and given the highly specific nature of C2c2 detection, it may be possible to track allelic specific expression of transcripts or disease-associated mutations in live cells. With the wide availability of aptamers, it might also be possible to sense proteins by coupling the detection of protein by an aptamer to the revealing of a cryptic amplification site for RPA followed by C2c2 detection.

Nucleic Acid Detection with CRISPR-Cas13a/C2c2: Attomolar Sensitivity and Single Nucleotide Specificity To achieve robust signal detection, we identified an ortholog of Cas13a from *Leptotrichia wadei* (LwCas13a), which displays greater RNA-guided RNase activity relative to *Leptotrichia shahii* Cas13a (LshCas13a) (10) (FIG. 2, see also above "Characterization of LwCas13a cleavage requirements"). LwCas13a incubated with ssRNA target 1 (ssRNA 1), crRNA, and reporter (quenched fluorescent RNA) (FIG. 18) (13) yielded a detection sensitivity of ~50 fM (FIGS. 51, 15), which is not sensitive enough for many diagnostic applications (12, 14-16). We therefore explored combining Cas13a-based detection with different isothermal amplification steps (FIGS. 10, 11, 53, 16) (17, 18). Of the methods explored, recombinase polymerase amplification (RPA) (18) afforded the greatest sensitivity and can be coupled with T7 transcription to convert amplified DNA to RNA for subsequent detection by LwCas13a (see also above "Discussion of Recombinase Polymerase Amplification (RPA) and other isothermal amplification strategies."). We refer to this combination of amplification by RPA, T7 RNA polymerase transcription of amplified DNA to RNA, and detection of target RNA by Cas13a collateral RNA cleavage-mediated release of reporter signal as SHERLOCK.

Figure 27:
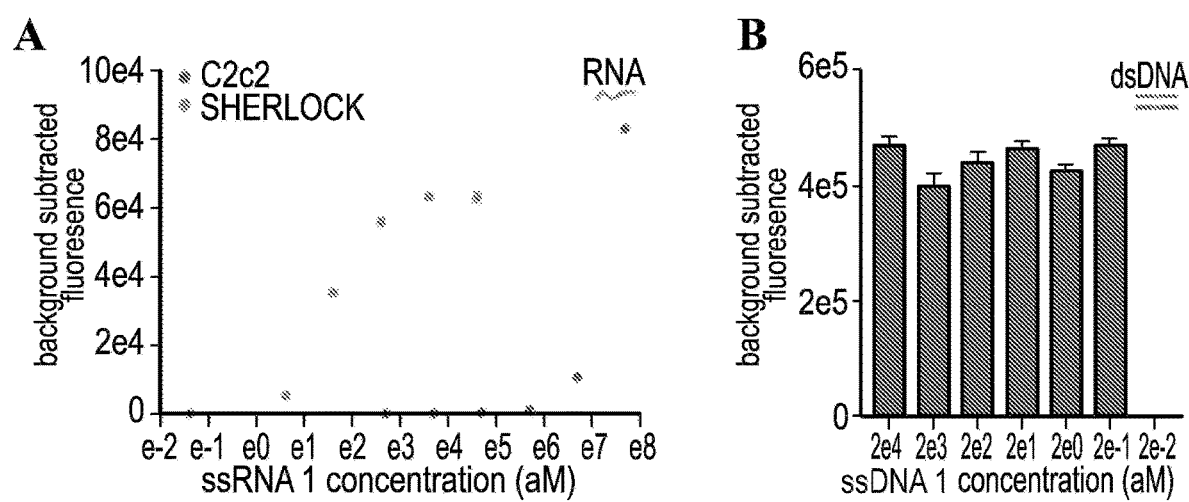
FIG. 27—provides a set of graphs demonstrating that (A) C2c2 detection of RNA without amplification can detect ssRNA target at concentrations down to 50 fM (n=2 technical replicates; bars represent mean±s.e.m.), and that (B) the RPA-C2c2 reaction is capable of single-molecule DNA detection (n=4 technical replicates; bars represent mean±s.e.m.).
Figure 28:
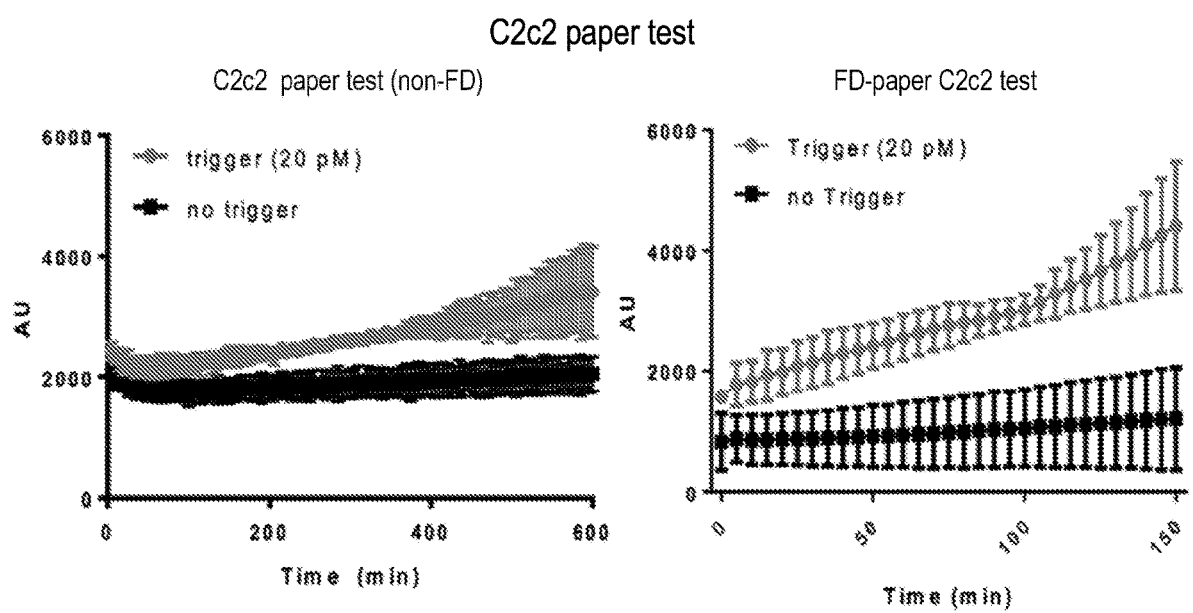
FIG. 28—provides a set of graphs demonstrating that a C2c2 signal generated in accordance with certain example embodiments can detect a 20 pM target on a paper substrate.
Figure 29:
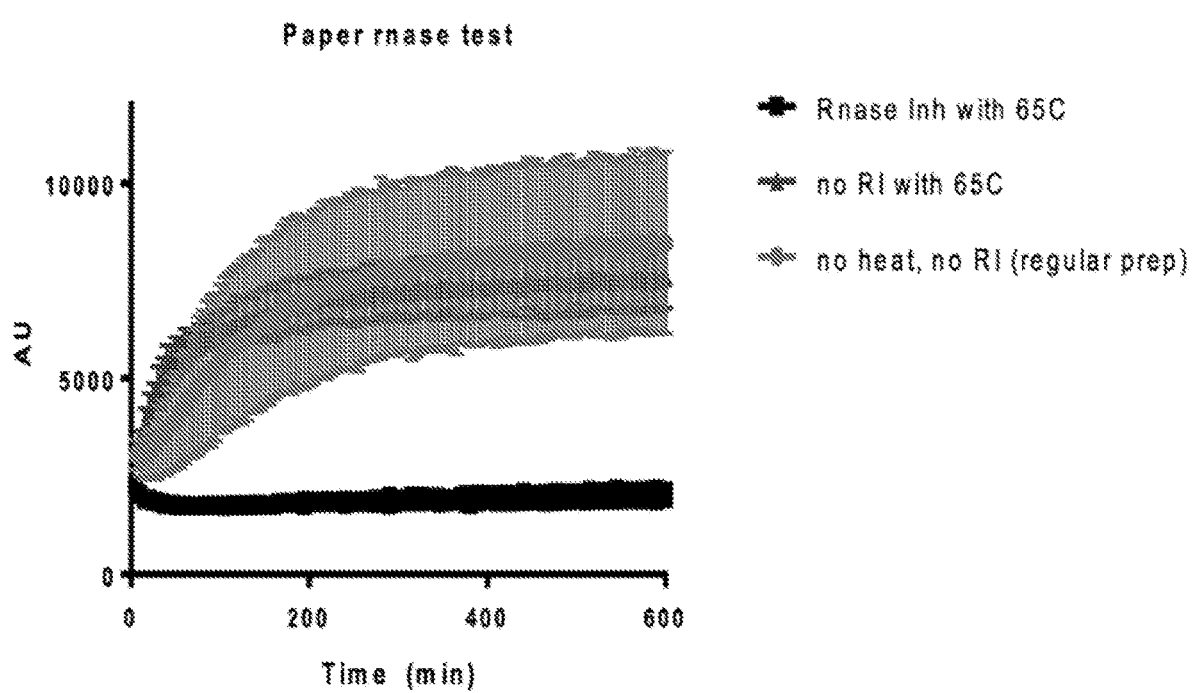
FIG. 29—provides a graph showing that a specific RNAse inhibitor is capable of removing background signal on paper.
Figure 30:
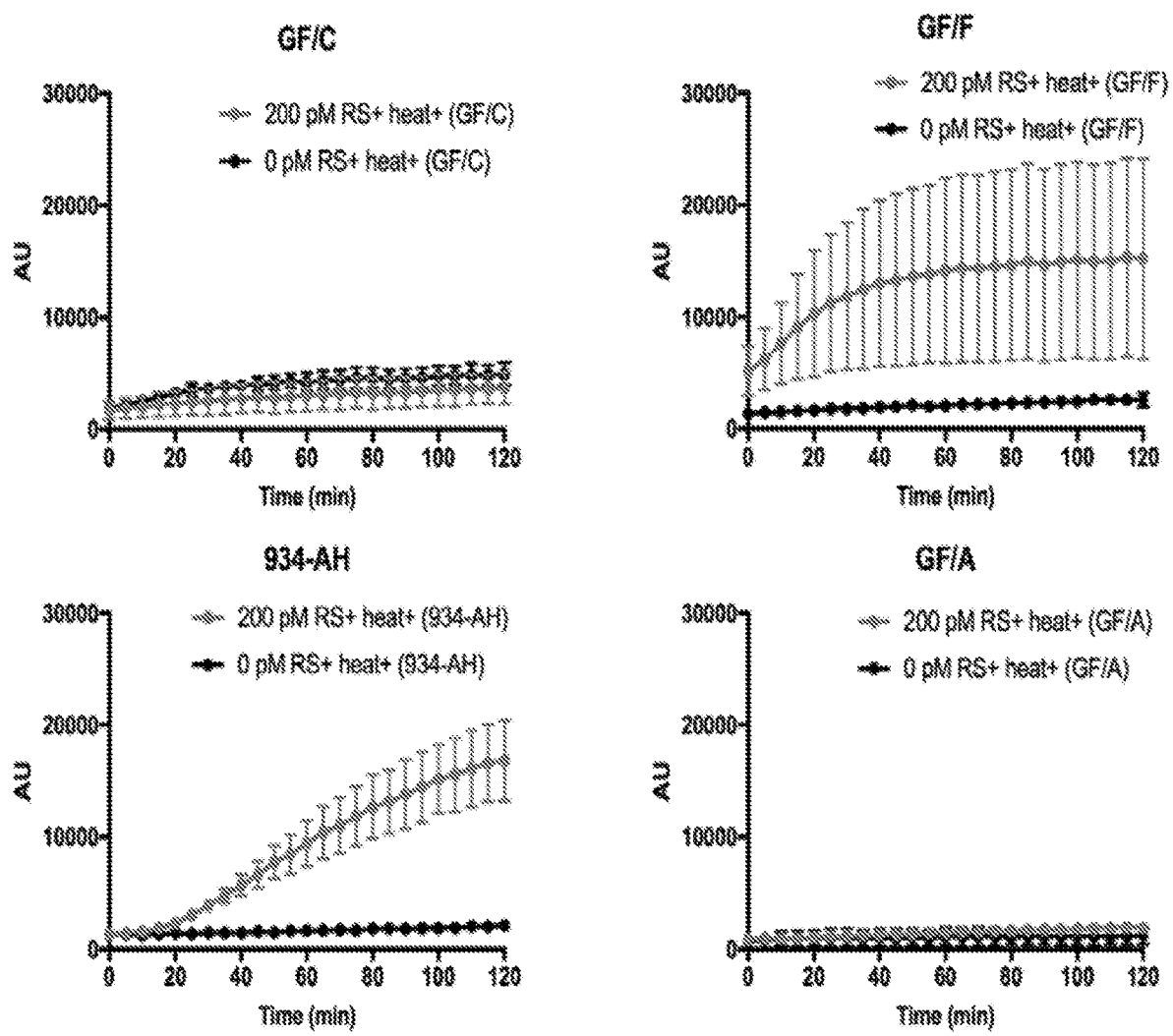
FIG. 30 is a set of graphs showing detection using systems in accordance with certain example embodiments on glass fiber substrates.
Figure 51:
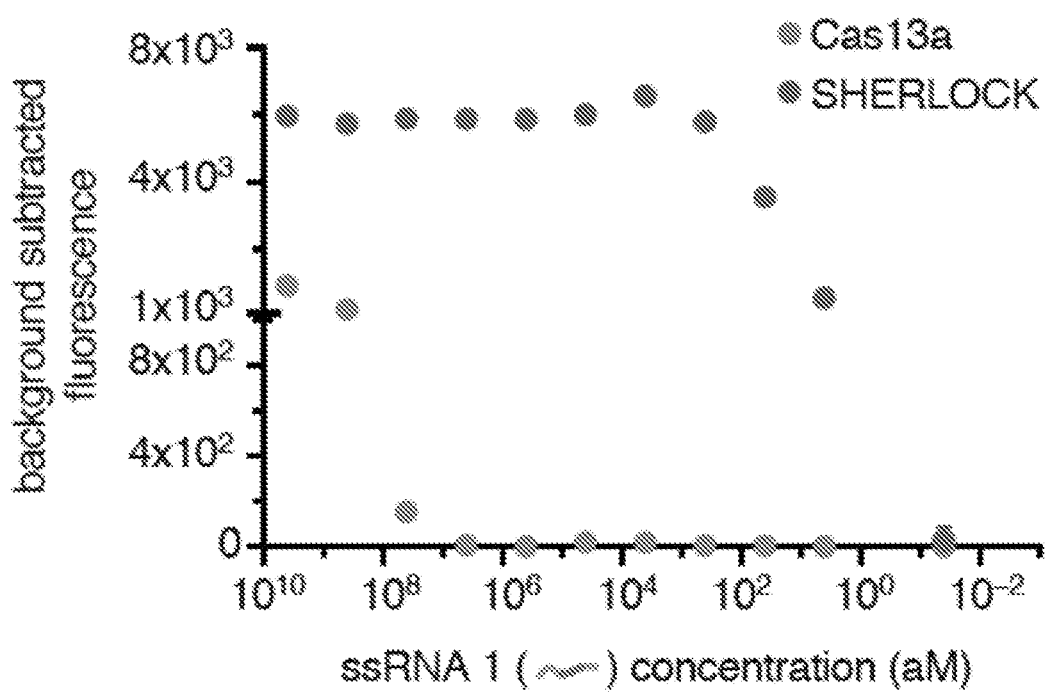
FIG. 51 Cas13a detection of RNA with RPA amplification (SHERLOCK) can detect ssRNA target at concentrations down to ~2 aM, more sensitive than Cas13a alone (n=4 technical replicates; bars represent mean±s.e.m.).
Figure 54:
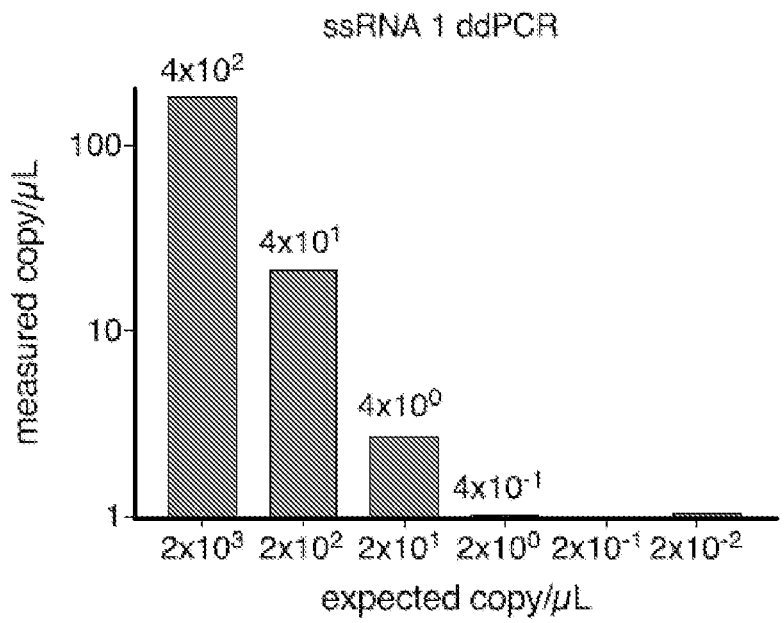
FIG. 54 Nucleic acid amplification with RPA and single-reaction SHERLOCK. (A) Digital-droplet PCR quantitation of ssRNA 1 for dilutions used. Adjusted concentrations for the dilutions based on the ddPCR results are shown above bar graphs. (B) Digital-droplet PCR quantitation of ssDNA 1 for dilutions used. Adjusted concentrations for the dilutions based on the ddPCR results are shown above bar graphs. (C) The RPA, T7 transcription, and Cas13a detection reactions are compatible and achieve single molecule detection of DNA 2 when incubated simultaneously (n=3 technical replicates, two-tailed Student t-test; n.s., not significant; , p<0.01; **, p<0.0001; bars represent mean±s.e.m.).

We first determined the sensitivity of SHERLOCK for detection of RNA (when coupled with reverse transcription) or DNA targets. We achieved single molecule sensitivity for both RNA and DNA, as verified by digital-droplet PCR (ddPCR) (FIGS. 27, 51, 54A,B). Attomolar sensitivity was maintained when we combined all SHERLOCK components in a single reaction, demonstrating the viability of this platform as a point-of-care (POC) diagnostic (FIG. 54C). SHERLOCK has similar levels of sensitivity as ddPCR and quantitative PCR (qPCR), two established sensitive nucleic acid detection approaches, whereas RPA alone was not sensitive enough to detect low levels of target (FIG. 55A-D). Moreover, SHERLOCK shows less variation than ddPCR, qPCR, and RPA, as measured by the coefficient of variation across replicates (FIG. 55E-F).

Figure 56:
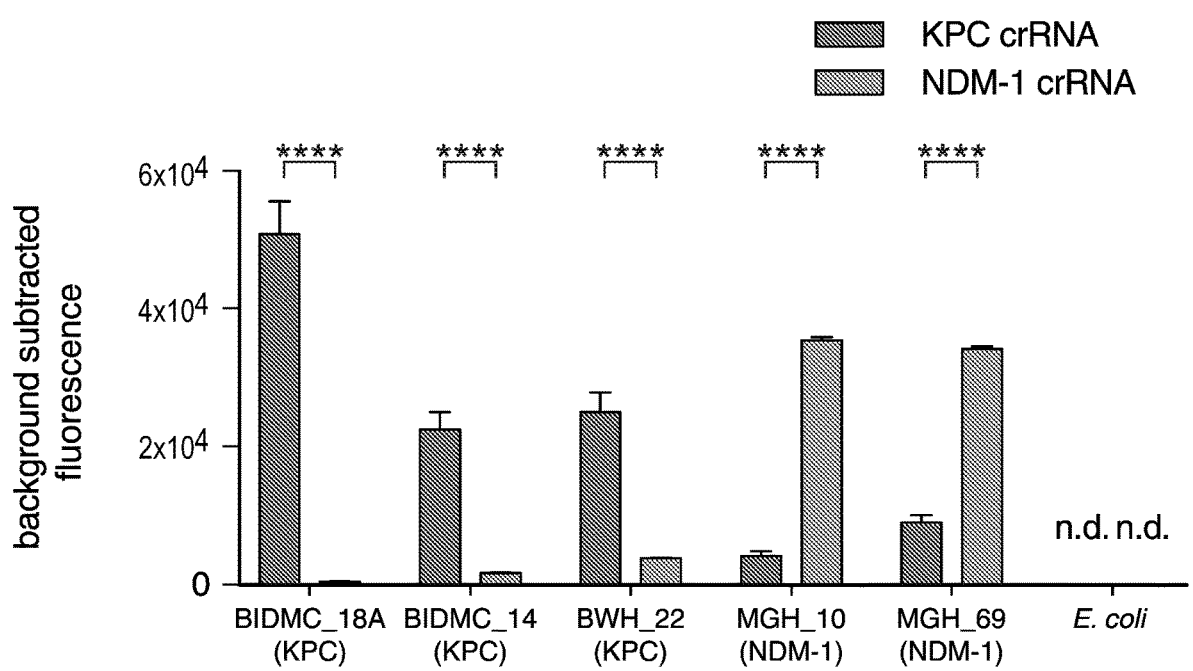
FIG. 56—Detection of carbapanem resistance in clinical bacterial isolates. Detection of two different carbapenem-resistance genes (KPC and NDM-1) from five clinical isolates of *Klebsiella pneumoniae* and an *E. coli* control (n=4 technical replicates, two-tailed Student t-test; ****, p<0.0001; bars represent mean±s.e.m.; n.d., not detected).
Figure 59:
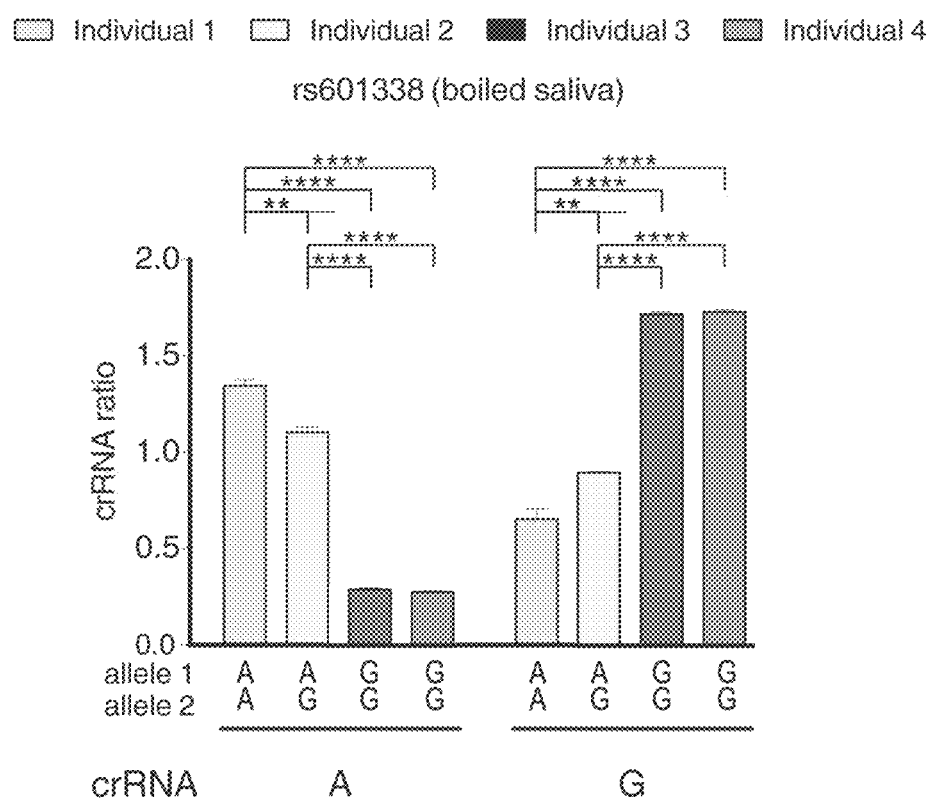
FIG. 59—Genotyping with SHERLOCK at an additional locus and direct genotyping from boiled saliva. SHERLOCK can distinguish between genotypes at the rs601338 SNP site in genomic DNA directly from centrifuged, denatured, and boiled saliva (n=4 technical replicates, two-tailed Student t-test; , p<0.01; **, p<0.001; bars represent mean±s.e.m.).

We next examined whether SHERLOCK would be effective in infectious disease applications that require high sensitivity. We produced lentiviruses harboring genome fragments of either Zika virus (ZIKV) or the related flavivirus Dengue (DENV) (19) (FIG. 31A). SHERLOCK detected viral particles down to 2 aM and could discriminate between ZIKV and DENV (FIG. 31B). To explore the potential use of SHERLOCK in the field, we first demonstrated that Cas13acrRNA complexes lyophilized and subsequently rehydrated (20) could detect 20 fM of nonamplified ssRNA 1 (FIG. 33A) and that target detection was also possible on glass fiber paper (FIG. 33B). The other components of SHERLOCK are also amenable to freeze-drying: RPA is provided as a lyophilized reagent at ambient temperature, and we previously demonstrated that T7 polymerase tolerates freeze-drying (2). In combination, freeze-drying and paper-spotting the Cas13a detection reaction resulted in comparable levels of sensitive detection of ssRNA 1 as aqueous reactions (FIG. 33C-E). Although paper-spotting and lyophilization slightly reduced the absolute signal of the readout, SHERLOCK (FIG. 31C) could readily detect mock ZIKV virus at concentrations as low as 20 aM (FIG. 31D). SHERLOCK is also able to detect ZIKV in clinical isolates (serum, urine, or saliva) where titers can be as low as 2×103 copies/mL (3.2 aM) (21). ZIKV RNA extracted from patient serum or urine samples and reverse transcribed into cDNA (FIG. 52A) could be detected at concentrations down to 1.25×103 copies/mL (2.1 aM), as verified by qPCR (FIG. 52B). Furthermore, the signal from patient samples was predictive of ZIKV RNA copy number and could be used to predict viral load (FIG. 33F). To simulate sample detection without nucleic acid purification, we measured detection of ssRNA 1 spiked into human serum and found that Cas13a could detect RNA in reactions containing as much as 2% serum (FIG. 33G). Another important epidemiological application for CRISPR-dx is the identification of bacterial pathogens and detection of specific bacterial genes. We targeted the 16S rRNA gene V3 region, where conserved flanking regions allow universal RPA primers to be used across bacterial species and the variable internal region allows for differentiation of species. In a panel of five possible targeting crRNAs for different pathogenic strains and gDNA isolated from *E. coli* and *Pseudomonas aeruginosa* (FIG. 34A), SHERLOCK correctly genotyped strains and showed low cross-reactivity (FIG. 34B). Additionally, we were able to use SHERLOCK to distinguish between clinical isolates of *Klebsiella pneumoniae* with two different resistance genes: *Klebsiella pneumoniae* carbapenemase (KPC) and New Delhi metallo-beta-lactamase 1 (NDM-1) (22) (FIG. 56).

Figure 38:
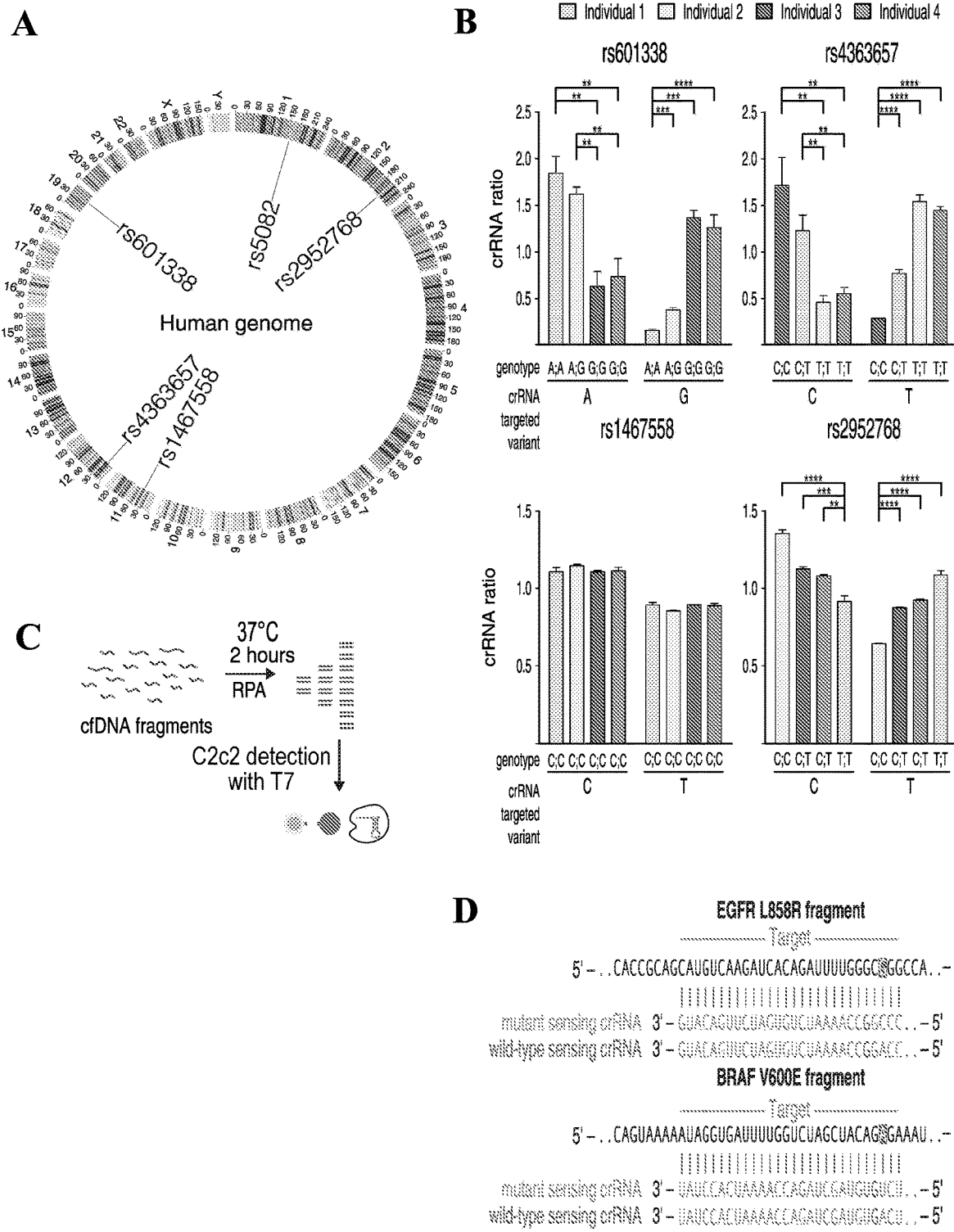
FIG. 38—provides a set of graphs showing (A) circos plot showing location of human SNPs detected with C2c2. (B) The assay conducted in accordance with certain example embodiments can distinguish between human SNPs. SHERLOCK can correctly genotype four different individuals at four different SNP sites in the human genome. The genotypes for each individual and identities of allele-sensing crRNAs are annotated below each plot (n=4 technical replicates; two-tailed Student t-test; *, p<0.05; , p<0.01; *, p<0.001; ****, p<0.0001; bars represent mean±s.e.m.), (C) A schematic of process for detection of cfDNA (such as cell free DNA detection of cancer muttions) in accordance with certain example embodiments. (D) Example crRNA sequences for detecting EGFR L858R and BRAF V600E. (SEQ ID NOS: 177 through 182). Sequences of two genomic loci assayed for cancer mutations in cell-free DNA. Shown are the target genomic sequence with the SNP highlighted in blue and the mutant/wildtype sensing crRNA sequences with synthetic mismatches colored in red.
Figure 61:
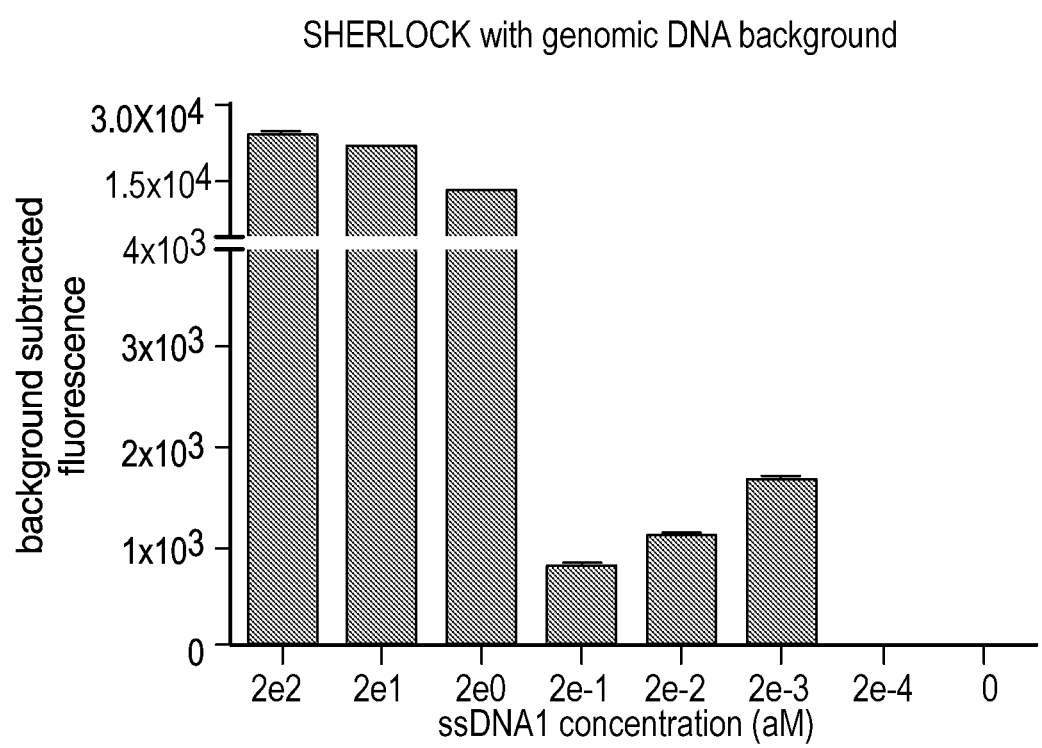
FIG. 61—Detection of ssDNA 1 as a small fraction of mismatched background target. SHERLOCK detection of a dilution series of ssDNA 1 on a background of human genomic DNA. Note that there should be no sequence similarity between the ssDNA 1 target being detected and the background genomic DNA (n=2 technical replicates; bars represent mean±s.e.m.).
Figure 62A:
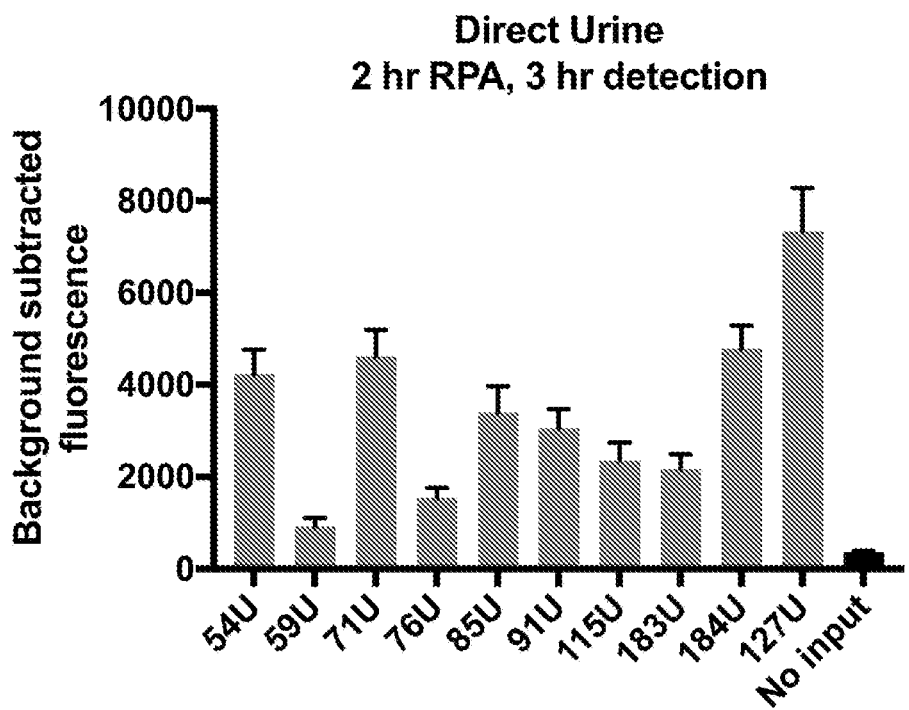
FIG. 62—Urine (A) or serum (B) samples from patients with Zika virus were heat inactivated for 5 minutes at 95° C. (urine) or 65° C. (serum). One microliter of inactivated urine or serum was used as input for a 2 hr RPA reaction followed by a 3-hour C2c2/Cas13a detection reaction, in accordance with an example embodiment. Error bards indicate 1 SD based on n=4 technical replicates for the detection reaction.
Figure 62B:
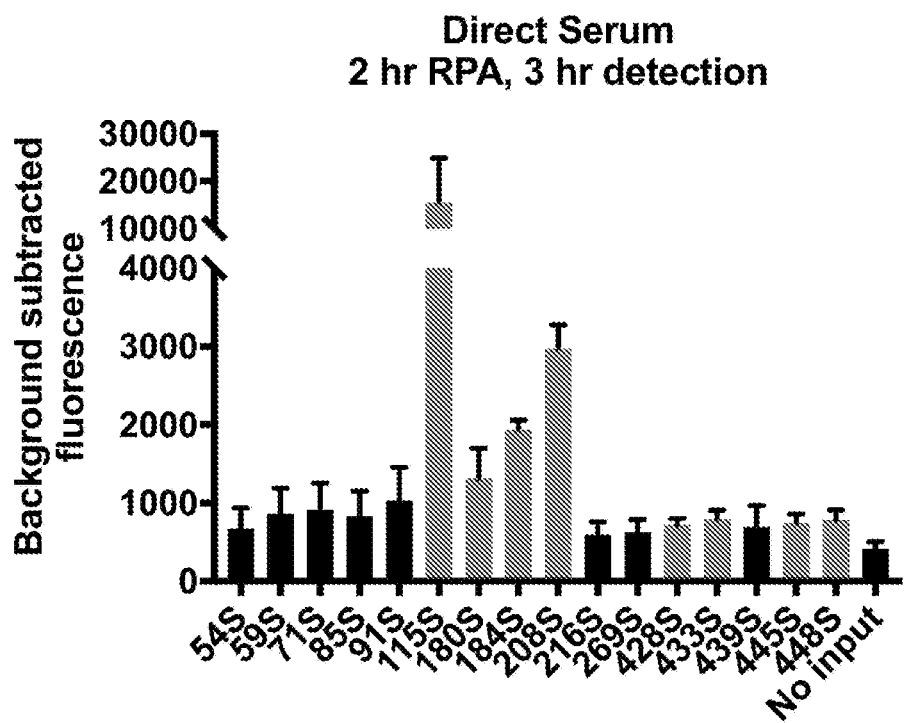
Figure 63A:
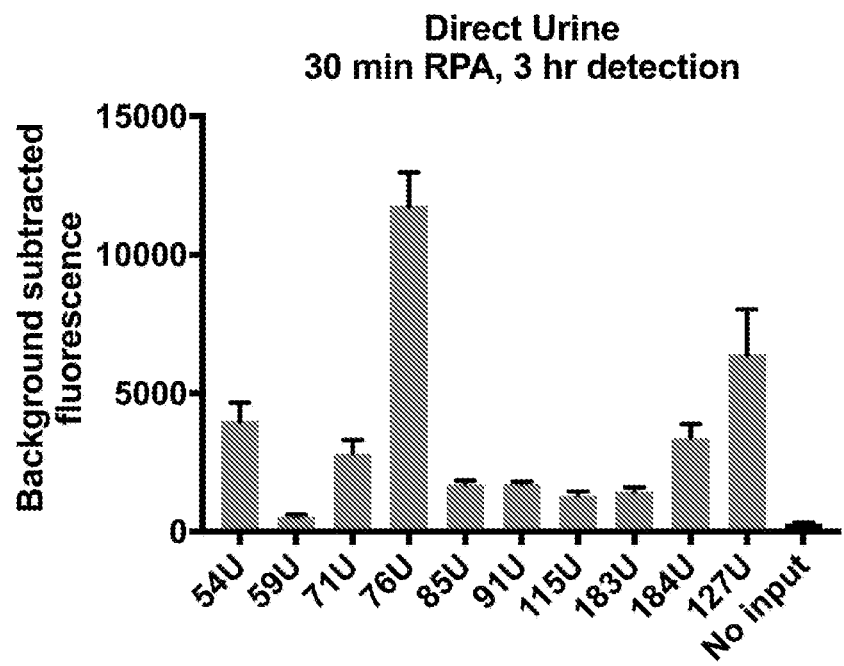
FIG. 63—Urine samples from patients with Zika virus were heat-inactivated for 5 minutes at 95° C. One microliter of inactivated urine was used as input for a 30-minute RPA reaction followed by a 3-hour (A) or 1-hour (B) C2c2/Cas13 detection reaction, in accordance with example embodiments. Error bars indicate 1 SD based on n=4 technical replicates for the detection reaction.
Figure 63B:
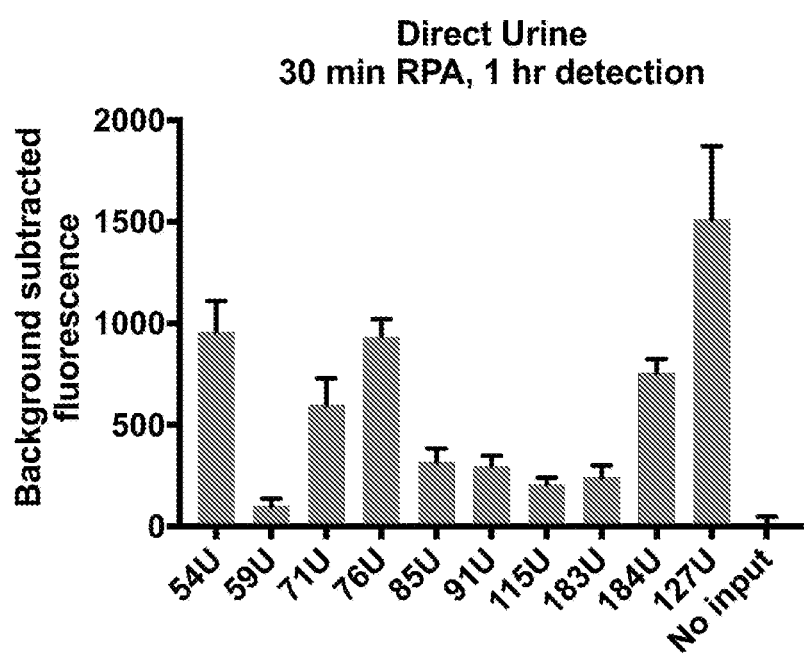
Figure 64:
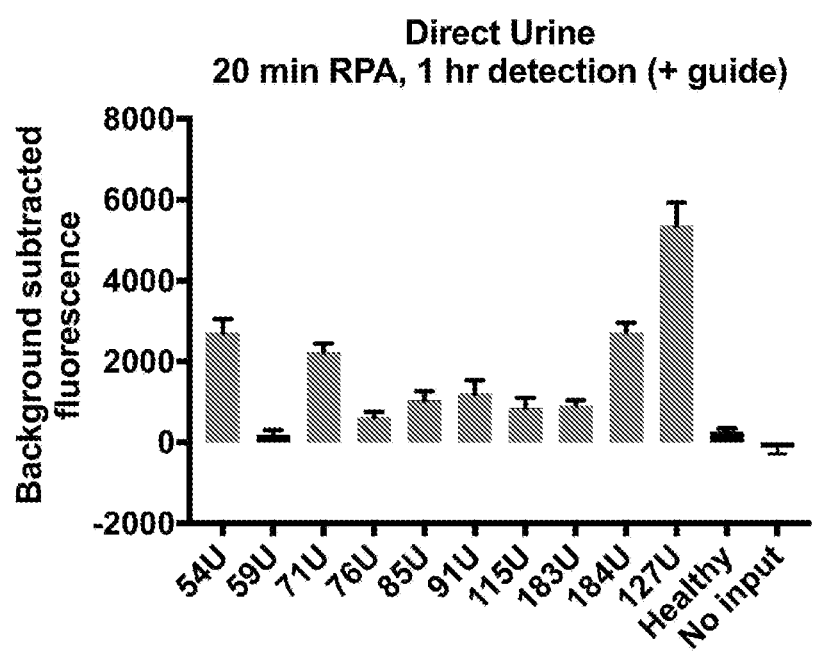
FIG. 64—Urine samples form patients with Zika virus were heat-inactivated for 5 minutes at 95° C. One microliter of inactivated urine was used as input for a 20-minute RPA reaction followed by a 1-hour C2c2/Cas13a detection reaction. Healthy human urine was used as a negative control. Error bars indicate 1 SD based on n=4 technical replicates or the detection reaction.
Figure 65A:
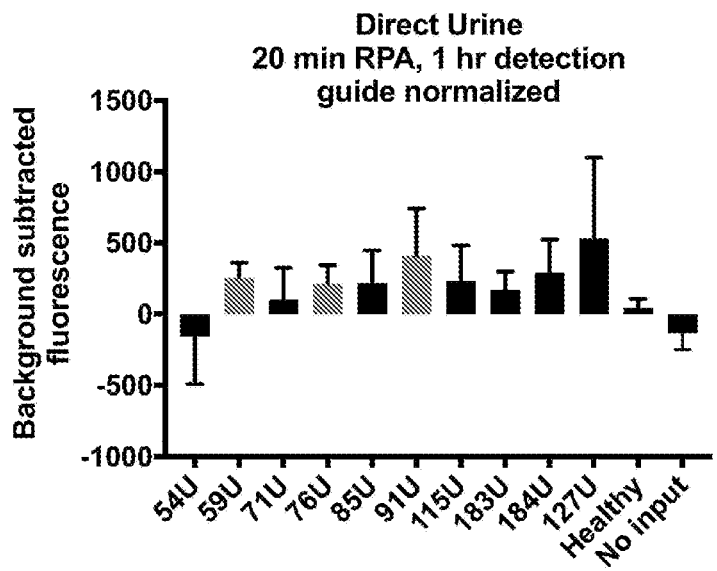
FIG. 65—Urine samples from patients with Zika virus were heat-inactivated for 5 minutes at 95° C. One microliters of inactivated urine was used as input for a 20-minute RPA reaction followed by a 1-hour C2c2/Cas13a detection reaction, in the presence or absence of guide RNA. Data are normalized by subtracting the average fluorescence values for no-guide detection reactions from the detection reactions containing guides. Healthy human urine was used as a negative control. Error bars indicate 1 SD based on n=4 technical replicates for the detection reaction.
Figure 65B:
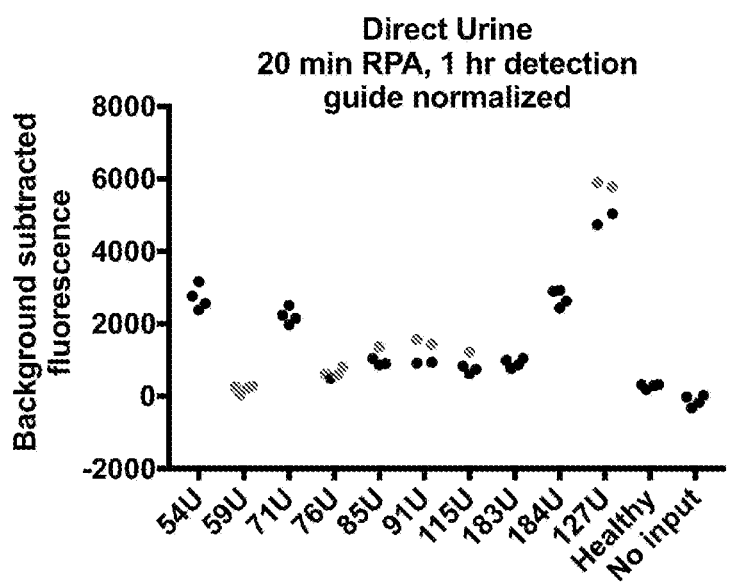

To increase the specificity of SHERLOCK, we introduced synthetic mismatches in the crRNA:target duplex that enable LwCas13a to discriminate between targets that differ by a single-base mismatch (FIG. 36A,B; see also above "Design of engineered mismatches"). We designed multiple crRNAs with synthetic mismatches in the spacer sequences to detect either the African or American strains of ZIKV (FIG. 37A) and strain 1 or 3 of DENV (FIG. 37C). Synthetic mismatch crRNAs detected their corresponding strains with significantly higher signal (two-tailed Student t-test; p<0.01) than the off-target strain, allowing for robust strain discrimination based off single mismatches (FIG. 37B,D, 36C). Further characterization revealed that Cas13a detection achieves maximal specificity while maintaining on-target sensitivity when a mutation is in position 3 of the spacer and the synthetic mismatch is in position 5 (FIGS. 57 and 58). The ability to detect single-base differences opens the opportunity of using SHERLOCK for rapid human genotyping. We chose five loci spanning a range of health-related single-nucleotide polymorphisms (SNPs) (Table 1) and benchmarked SHERLOCK detection using 23andMe genotyping data as the gold standard at these SNPs (23) (FIG. 38A). We collected saliva from four human subjects with diverse genotypes across the loci of interest and extracted genomic DNA either through commercial column purification or direct heating for five minutes (20). SHERLOCK distinguished alleles with high significance and with enough specificity to infer both homozygous and heterozygous genotypes (FIGS. 38B, 40, 59, 60; see also above "Genotyping with SHERLOCK using synthetic standards"). Finally, we sought to determine if SHERLOCK could detect low frequency cancer mutations in cell free (cf) DNA fragments, which is challenging because of the high levels of wild-type DNA in patient blood (24-26). We first found that SHERLOCK could detect ssDNA 1 at attomolar concentrations diluted in a background of genomic DNA (FIG. 61). Next, we found that SHERLOCK was also able to detect single nucleotide polymorphism (SNP)-containing alleles (FIG. 41A,B) at levels as low as 0.1% of background DNA, which is in the clinically relevant range. We then demonstrated that SHERLOCK could detect two different cancer mutations, EGFR L858R and BRAF V600E, in mock cfDNA samples with allelic fractions as low as 0.100 (FIGS. 38, 39) (20).

The SHERLOCK platform lends itself to further applications including (i) general RNA/DNA quantitation in lieu of specific qPCR assays, such as TaqMan, (ii) rapid, multiplexed RNA expression detection, and (iii) other sensitive detection applications, such as detection of nucleic acid contamination. Additionally, Cas13a could potentially detect transcripts within biological settings and track allele-specific expression of transcripts or disease-associated mutations in live cells. We have shown that SHERLOCK is a versatile, robust method to detect RNA and DNA, suitable for rapid diagnoses including infectious disease applications and sensitive genotyping. A SHERLOCK paper test can be redesigned and synthesized in a matter of days for as low as $0.61/test (see also above "SHERLOCK is an affordable, adaptable CRISPR-Dx platform") with confidence, as almost every crRNA tested resulted in high sensitivity and specificity. These qualities highlight the power of CRISPR-Dx and open new avenues for rapid, robust and sensitive detection of biological molecules.

TABLE 16

RPA Primers used

| Name | Sequence | 1st Fig. |
|---|---|---|
| RP0683 - RPA ssDNA/ssRNA 1 F | AATTCTAATACGACTCACTATAGGGATCCTCTAGAA ATATGGATTACTTGGTAGAACAG (SEQ. ID NO: 18) | FIG. 27B |
| RP0684 - RPA ssDNA/ssRNA 1 R | GATAAACACAGGAAACAGCTATGACCATGATTACG (SEQ. ID NO: 19) | FIG. 27B |
| AMPL-25 Zika 8B long-rpa3-f | AAT TCT AAT ACG ACT CAC TAT AGGCCGCTGCTAATGATAGGTTGCTACTCACAA (SEQ. ID NO: 20) | FIG. 31B |
| AMPL-26 Zika 8B long-rpa3-r | TCAATGTCAGTCACCACTATTCCATCCACAACAG (SEQ. ID NO: 21) | FIG. 31B |
| RP819 - zika region 8 F | gaaatTAATACGACTCACTATAGGGCGTGGCGCACTAC ATGTACT (SEQ. ID NO: 22) | FIG. 31C |
| RP821 - zika region 8 R | TGTCAATGTCAGTCACCACTATTCCATCCA (SEQ. ID NO: 23) | FIG. 31C |
| 517 bacterial V3 F | AATTCTAATACGACTCACTATAGGGtccaGACTCCTAC GGGAGGCWGCA (SEQ. ID NO: 24) | FIG. 34B |

TABLE 16-continued

RPA Primers used

| Name | Sequence | 1st Fig. |
|---|---|---|
| RP758 bacterial V3 R | TTTCGCTCTATTCTCATCAGTTTCATGTCCTGTGTCA TTACCGCGGCTGCTG (SEQ. ID NO: 25) | FIG. 34B |
| wR0074 A2 rs5082 F | GGTACACTTCAGGTATATTTGAGGTTCATTC (SEQ. ID NO: 26) | FIG. 38B |
| wR0074 E2 rs5082 R | gaaattaatacgactcactatagggGTTGATATGTCAGAGCTTTCC AGAGAAATAA (SEQ. ID NO: 27) | FIG. 38B |
| wR0074 A4 rs1467558 F | ACACTAATATTGATTCCTTCAGATATGGACT (SEQ. ID NO: 28) | FIG. 38B |
| wR0074 E4 rs1467558 R | gaaattaatacgactcactatagggATCGTTATTCTTACGCGTTGT CATTGAAAG (SEQ. ID NO: 29) | FIG. 38B |
| wR0074 A5 rs2952768 F | GAATCTCTTGAACCCAGTAGGCAGAGGTTG (SEQ. ID NO: 30) | FIG. 38B |
| wR0074 E5 rs2952768 R | gaaattaatacgactcactatagggAAAGGCCTAAGTGTCCTTCTA CCATTATTTTG (SEQ. ID NO: 31) | FIG. 38B |
| wR0074 A9 rs4363657 F | TTTGTTTTTGATGTTGTTGTTGTTTTTGTGTC (SEQ. ID NO: 32) | FIG. 38B |
| wR0074 E9 rs4363657 R | gaaattaatacgactcactatagggAATGCATTCATAGCCAAATTC TACTGAAATA (SEQ. ID NO: 33) | FIG. 38B |
| wR0074 A11 rs601338 F | GAGTACGTCCGCTTCACCGGCTACCCCTGCTC (SEQ. ID NO: 34) | FIG. 38B |
| wR0074 E11 rs601338 R | gaaattaatacgactcactatagggATAGTCCCCTCGGCGAACATG GACCCCTACAA (SEQ. ID NO: 35) | FIG. 38B |
| RP824 BRAFV600E cfDNA F | gaaatTAATACGACTCACTATAGGGTCATGAAGACCTC ACAGTAAAAATAGGTGATT (SEQ. ID NO: 36) | FIG. 39A |
| RP769 BRAFV600E cfDNA R | ATTCTTACCATCCACAAAATGGATCCAGACAA (SEQ. ID NO: 37) | FIG. 39A |
| RP826 EGFR858R cfDNA F | gaaatTAATACGACTCACTATAGGGGCAGCATGTCAA GATCACAGATTTTGGG (SEQ. ID NO: 38) | FIG. 39B |
| RP804 EGFR858R cfDNA R | CCTCCTTCTGCATGGTATTCTTTCTCTTC (SEQ. ID NO: 39) | FIG. 39B |
| AMPL-31 T1-nasba1-f | AAT TCT AAT ACG ACT CAC TAT AGGGGGATCCTCTAGAAATATGGATT (SEQ. ID NO: 40) | FIG. 11 |
| AMPL-32 T1-nasba1-r | CTCGTATGTTGTGTGGAATTGT (SEQ. ID NO: 41) | FIG. 11 |
| AMPL-33 T1-nasba2-f | AAT TCT AAT ACG ACT CAC TAT AGGGGGATCCTCTAGAAATATGGATTAC (SEQ. ID NO: 42) | FIG. 11 |
| AMPL-34 T1-nasba2-r | AAACACAGGAAACAGCTATGAC (SEQ. ID NO: 43) | FIG. 11 |
| AMPL-35 T1-nasba3-f | AAT TCT AAT ACG ACT CAC TAT AGGCCTCTAGAAATATGGATTACTTGGT (SEQ. ID NO: 44) | FIG. 11 |
| AMPL-36 T1-nasba3-r | CGTATGTTGTGTGGAATTGTGA (SEQ. ID NO: 45) | FIG. 11 |
| wR0075 A1 KPC F | gaaattaatacgactcactatagggCTGTCTTGTCTCTCATGGCCG CTGGCTGGCTTTTC (SEQ. ID NO: 46) | FIG. 35A |
| wR0075 B1 KPC R | CGTACACACCGATGGAGCCGCCAAAGTCCTGTT (SEQ. ID NO: 47) | FIG. 35A |
| wR0075 A3 NDM F | gaaattaatacgactcactatagggAGCAAATGGAAACTGGCGAC CAACGGTTTGGCGAT (SEQ. ID NO: 48) | FIG. 35A |

TABLE 16-continued

RPA Primers used

| Name | Sequence | 1st Fig. |
|---|---|---|
| wR0075 B3 NDM R | ACTGCCCCGAAACCCGGCATGTCGAGATAGGA (SEQ. ID NO: 49) | FIG. 35A |

TABLE 17 crRNA sequences used

| Name | Complete crRNA sequence | Spacer sequence | 1st Fig. | PFS |
|---|---|---|---|---|
| Target 1 crRNA | (SEQ ID NO: 50) | (SEQ ID NO: 51) | FIG. 2F | C |
| Zika targeting crRNA 1 | (SEQ ID NO: 52) | (SEQ ID NO: 53) | FIG. 31A | U |
| Zika targeting crRNA 2 | (SEQ ID NO: 54) | (SEQ ID NO: 55) | FIG. 33D | G |
| E. coli detection crRNA | (SEQ ID NO: 56) | (SEQ ID NO: 57) | FIG. 22B | U |
| K. pneumoniae detection crRNA | (SEQ ID NO: 58) | (SEQ ID NO: 59) | FIG. 34B | U |
| P. aeruginosa detection crRNA | (SEQ ID NO: 60) | (SEQ ID NO: 61) | FIG. 34B | U |
| M. tuberculosis detection crRNA | (SEQ ID NO: 62) | (SEQ ID NO: 63) | FIG. 34B | U |
| S. aureus detection crRNA | (SEQ ID NO: 64) | (SEQ ID NO: 65) | FIG. 34B | G |
| KPC crRNA | (SEQ ID NO: 66) | (SEQ ID NO: 67) | FIG. 35A | U |
| NDM crRNA | (SEQ ID NO: 68) | (SEQ ID NO: 69) | FIG. 35A | C |
| mismatch crRNA 1 | (SEQ ID NO: 70) | (SEQ ID NO: 71) | FIG. 36A | C |
| mismatch crRNA 2 | (SEQ ID NO: 72) | (SEQ ID NO: 73) | FIG. 36A | C |
| mismatch crRNA 3 | (SEQ ID NO: 74) | (SEQ ID NO: 75) | FIG. 36A | C |
| mismatch crRNA 4 | (SEQ ID NO: 76) | (SEQ ID NO: 77) | FIG. 36A | C |
| mismatch crRNA 5 | (SEQ ID NO: 78) | (SEQ ID NO: 79) | FIG. 36A | C |
| mismatch crRNA 6 | (SEQ ID NO: 80) | (SEQ ID NO: 81) | FIG. 36A | C |
| mismatch crRNA 7 | (SEQ ID NO: 82) | (SEQ ID NO: 83) | FIG. 36A | C |
| mismatch crRNA 8 | (SEQ ID NO: 84) | (SEQ ID NO: 85) | FIG. 36A | C |
| mismatch crRNA 9 | (SEQ ID NO: 86) | (SEQ ID NO: 87) | FIG. 36A | C |
| mismatch crRNA 10 | (SEQ ID NO: 88) | (SEQ ID NO: 89) | FIG. 36A | C |
| African crRNA 1 | (SEQ ID NO: 90) | (SEQ ID NO: 91) | FIG. 38A | C |
| African crRNA 2 | (SEQ ID NO: 92) | (SEQ ID NO: 93) | FIG. 38A | C |
| American crRNA 1 | (SEQ ID NO: 94) | (SEQ ID NO: 95) | FIG. 38A | U |
| American crRNA 2 | (SEQ ID NO: 96) | (SEQ ID NO: 97) | FIG. 38A | U |
| Dengue strain 3 crRNA 1 | (SEQ ID NO: 98) | (SEQ ID NO: 99) | FIG. 38C | A |
| Dengue strain 3 crRNA 2 | (SEQ ID NO: 100) | (SEQ ID NO: 101) | FIG. 38C | A |
| Dengue strain 1 crRNA 1 | (SEQ ID NO: 102) | (SEQ ID NO: 103) | FIG. 38C | A |
| Dengue strain 1 crRNA 2 | (SEQ ID NO: 104) | (SEQ ID NO: 105) | FIG. 38C | A |
| Shorter African crRNA 1 | (SEQ ID NO: 106) | (SEQ ID NO: 107) | FIG. 36C | C |
| Shorter African crRNA 2 | (SEQ ID NO: 108) | (SEQ ID NO: 109) | FIG. 36C | C |
| Shorter American crRNA 1 | (SEQ ID NO: 110) | (SEQ ID NO: 111) | FIG. 36C | U |
| Shorter American crRNA 2 | (SEQ ID NO: 112) | (SEQ ID NO: 113) | FIG. 36C | U |
| rs1467558 crRNA C | (SEQ ID NO: 114) | (SEQ ID NO: 115) | FIG. 38B | C |
| rs1467558 crRNA T | (SEQ ID NO: 116) | (SEQ ID NO: 117) | FIG. 38B | C |
| rs2952768 crRNA C | (SEQ ID NO: 118) | (SEQ ID NO: 119) | FIG. 38B | A |
| rs2952768 crRNA T | (SEQ ID NO: 120) | (SEQ ID NO: 121) | FIG. 38B | A |
| rs4363657 crRNA C | (SEQ ID NO: 122) | (SEQ ID NO: 123) | FIG. 38B | A |
| rs4363657 crRNA T | (SEQ ID NO: 124) | (SEQ ID NO: 125) | FIG. 38B | A |
| rs601338 crRNA A | (SEQ ID NO: 126) | (SEQ ID NO: 127) | FIG. 38B | G |
| rs601338 crRNA G | (SEQ ID NO: 128) | (SEQ ID NO: 129) | FIG. 38B | G |
| rs5082 crRNA G | (SEQ ID NO: 130) | (SEQ ID NO: 131) | FIG. 40A | A |
| rs5082 crRNA A | (SEQ ID NO: 132) | (SEQ ID NO: 133) | FIG. 40A | A |
| EGFR L858R wild-type crRNA | (SEQ ID NO: 134) | (SEQ ID NO: 135) | FIG. 38C | C |
| EGFR L858R mutant crRNA | (SEQ ID NO: 136) | (SEQ ID NO: 137) | FIG. 38C | C |
| BRAF V600E wild-type crRNA | (SEQ ID NO: 138) | (SEQ ID NO: 139) | FIG. 38C | A |
| BRAF V600E mutant crRNA | (SEQ ID NO: 140) | (SEQ ID NO: 141) | FIG. 38C | A |
| 23 nt mismatch crRNA 1 | (SEQ ID NO: 303) | (SEQ ID NO: 304) | FIG. 57D | C |
| 23 nt mismatch crRNA 2 | (SEQ ID NO: 305) | (SEQ ID NO: 306) | FIG. 57D | C |
| 23 nt mismatch crRNA 4 | (SEQ ID NO: 307) | (SEQ ID NO: 308) | FIG. 57D | C |
| 23 nt mismatch crRNA 5 | (SEQ ID NO: 234) | (SEQ ID NO: 235) | FIG. 57D | C |
| 23 nt mismatch crRNA 6 | (SEQ ID NO: 236) | (SEQ ID NO: 237) | FIG. 57D | C |
| 23 nt mismatch crRNA 7 | (SEQ ID NO: 238) | (SEQ ID NO: 239) | FIG. 57D | C |
| 20 nt mismatch crRNA 1 | (SEQ ID NO: 240) | (SEQ ID NO: 241) | FIG. 57F | C |
| 20 nt mismatch crRNA 2 | (SEQ ID NO: 242) | (SEQ ID NO: 243) | FIG. 57F | C |
| 20 nt mismatch crRNA 4 | (SEQ ID NO: 244) | (SEQ ID NO: 245) | FIG. 57F | C |

TABLE 17-continued crRNA sequences used

| Name | Complete crRNA sequence | Spacer sequence | 1st Fig. | PFS |
|---|---|---|---|---|
| 20 nt mismatch crRNA 5 | (SEQ ID NO: 246) | (SEQ ID NO: 247) | FIG. 57F | C |
| 20 nt mismatch crRNA 6 | (SEQ ID NO: 248) | (SEQ ID NO: 249) | FIG. 57F | C |
| 20 nt mismatch crRNA 7 | (SEQ ID NO: 250) | (SEQ ID NO: 251) | FIG. 57F | C |
| target mismatch 4 mismatch crRNA 1 | (SEQ ID NO: 252) | (SEQ ID NO: 253) | FIG. 58B | C |
| target mismatch 4 mismatch crRNA 2 | (SEQ ID NO: 254) | (SEQ ID NO:255) | FIG. 58B | C |
| target mismatch 4 mismatch crRNA 3 | (SEQ ID NO: 256) | (SEQ ID NO: 257) | FIG. 58B | C |
| target mismatch 4 mismatch crRNA 5 | (SEQ ID NO: 258) | (SEQ ID NO: 259) | FIG. 58B | C |
| target mismatch 4 mismatch crRNA 6 | (SEQ ID NO: 260) | (SEQ ID NO: 261) | FIG. 58B | C |
| target mismatch 4 mismatch crRNA 7 | (SEQ ID NO: 262) | (SEQ ID NO: 263) | FIG. 58B | C |
| target mismatch 5 mismatch crRNA 2 | (SEQ ID NO: 264) | (SEQ ID NO: 265) | FIG. 58B | C |
| target mismatch 5 mismatch crRNA 3 | (SEQ ID NO: 266) | (SEQ ID NO: 267) | FIG. 58B | C |
| target mismatch 5 mismatch crRNA 4 | (SEQ ID NO: 268) | (SEQ ID NO: 269) | FIG. 58B | C |
| target mismatch 5 mismatch crRNA 6 | (SEQ ID NO: 270) | (SEQ ID NO: 271) | FIG. 58B | C |
| target mismatch 5 mismatch crRNA 7 | (SEQ ID NO: 272) | (SEQ ID NO: 273) | FIG. 58B | C |
| target mismatch 5 mismatch crRNA 8 | (SEQ ID NO: 274) | (SEQ ID NO: 275) | FIG. 58B | C |
| target mismatch 6 mismatch crRNA 3 | (SEQ ID NO: 276) | (SEQ ID NO: 277) | FIG. 58B | C |
| target mismatch 6 mismatch crRNA 4 | (SEQ ID NO: 278) | (SEQ ID NO: 279) | FIG. 58B | C |
| target mismatch 6 mismatch crRNA 5 | (SEQ ID NO: 280) | (SEQ ID NO: 281) | FIG. 58B | C |
| target mismatch 6 mismatch crRNA 7 | (SEQ ID NO: 282) | (SEQ ID NO: 283) | FIG. 58B | C |
| target mismatch 6 mismatch crRNA 8 | (SEQ ID NO: 284) | (SEQ ID NO: 285) | FIG. 58B | C |
| target mismatch 6 mismatch crRNA 9 | (SEQ ID NO: 286) | (SEQ ID NO: 287) | FIG. 58B | C |

TABLE 18

RNA and DNA targets used in this Example

| Name | Sequence | 1st Fig |
|---|---|---|
| ssRNA 1 (C PFS) | (SEQ ID NO: 288) | FIG. 2F |
| ssRNA 1 (G PFS) | (SEQ ID NO: 289) | FIG. 2F |
| ssRNA 1 (A PFS) | (SEQ ID NO: 290) | FIG. 2F |
| ssRNA 1 (U PFS) | (SEQ ID NO: 291) | FIG. 2F |
| ssDNA 1 | (SEQ ID NO: 292) | FIG. 27 |
| DNA 2 | (SEQ ID NO: 293) | FIG. 54B |
| ZIKV in lentivirus | (SEQ ID NO: 294) | FIG. 31B |
| DENV in lentivirus | (SEQ ID NO: 295) | FIG. 31B |
| Synthetic ZIKV target | (SEQ ID NO: 296) | FIG. 33D |
| Synthetic African ZIKV target | (SEQ ID NO: 297) | FIG. 37A |
| Synthetic American ZIKV target | (SEQ ID NO: 298) | FIG. 37A |
| Synthetic Dengue strain 1 target | (SEQ ID NO: 299) | FIG. 37C |
| Synthetic Dengue strain 3 target | (SEQ ID NO: 300) | FIG. 37C |
| ssRNA 2 | (SEQ ID NO: 301) | FIG. 36A |
| ssRNA 3 | (SEQ ID NO: 302) | FIG. 36A |

TABLE 19 plasmids used in this Example

| Plasmid Name | Description | Link to plasmid map |
|---|---|---|
| pC004 | beta-lactamase screening target | https://benchling.com/s/lPJ1cCwR |
| pC009 | LshCas13a locus into pACYC184 with targeting spacer | https://benchling.com/s/seqylkMuglYmiG4A3VhShZg |
| pC010 | LshCas13a locus into pACYC184 with nontargeting spacer | https://benchling.com/s/seq-2WApFr3zni1GOACyQY8a |
| pC011 | LwCas13a locus into pACYC184 with targeting spacer | https://benchling.com/s/seq-Vyk8qK2fyhzegfNgLJHM |
| pC012 | LwCas13a locus into pACYC184 with nontargeting spacer | https://benchling.com/s/seq-RxZAgPBzBUGQThkxR2Kx |
| pC013 | Twinstrep-SUMO-huLwCas13a for bacterial expression | https://benchling.com/s/seq-66CfLwu7sLMQMbcXe7Ih |

Example 3—C2c2 Prevents Infection and Reduces Replication of Lymphocytic Choriomeningitis (LCMV)

Figure 67:
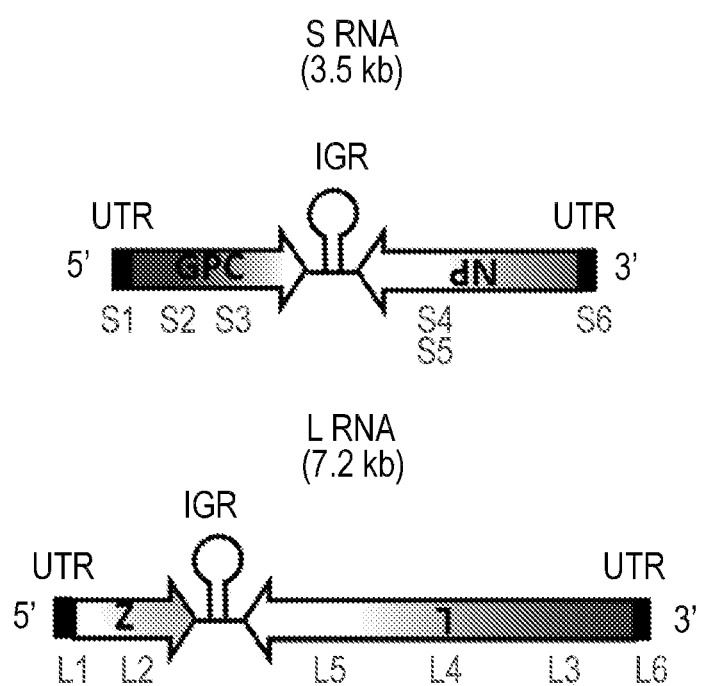
FIG. 67—shows location of designed guide RNAs along the segmented LCMV genome. Guide RNAs S1-S6 are complementary to the MCMV S RNA (of which S1 and S6 bind respectively to the 5' UTR and 3'UTR). Guide RNAs L1-L6 are complementary to the MCMV L RNA (of which L1 and L6 bind respectively to the 5' UTR and 3'UTR). All guide RNAs bind to the coding strand.

Guide RNAs were designed to bind to various areas of the LCMV genome, as indicated in FIG. 67 and are listed in Table 20 below.

TABLE 20

| gRNA annotation | gRNA sequence | SEQ ID NO |
|---|---|---|
| L1 | ctcacgaagaaagttgtgcaaccaaaca | 624 |
| L2 | tcttcaatctggttggtaatggatattt | 625 |
| L3 | gccaatttgttagtgtcctctataaatt | 626 |
| L4 | tatctcacagaccctatttgattttgcc | 627 |
| L5 | aaattcttcattaaattcaccatttttg | 628 |
| L6 | tatagtttaaacataactctctcaattc | 629 |
| S1 | atccaaaaagcctaggatcccggtgcg | 630 |
| S2 | agaatgtcaagttgtattggatggttat | 631 |
| S3 | aaagcagccttgttgtagtcaattagtc | 632 |
| S4 | tgatctctttcttcttttgtcccttac | 633 |
| S5 | tctctttcttcttttgtcccttactat | 634 |
| S6 | caatcaaatgcctaggatccactgtgcg | 635 |

A plasmid expressing *Leptotrichia wadei* (Lw) C2c2/Cas13a fused to msfGFP with a nuclear export signal, and a plasmid expressing guide RNA were transfected into 293FT cells using Lipofectamine 2000. 293FT cells were plated simultaneously to lipofectamine-plasmid mixture addition. After 24 h, the transfected 293FT cells were infected with LCMV armstrong (MOI 5, 1 h) (viral titer was determined by focus forming unit assay with Vero cells). After 1 hour of infection, cells were washed with citrate buffer to destroy virus remaining in the infection media that did not infect the cells. 48 hours post infection, virus-containing supernatant was removed and diluted 1.10 in Nuclease-free water and then used as input for RT-qPCR with primers against LCMV GP. The results are shown in FIG. 68.

293FT cells were plated 1 day prior to LCMV infection, so that infection was performed at approximately 80-85% confluency. 24 h post plating, 293FT cells were infected with LCMV Armstrong (MOI 5, 1 h) (viral titer was determined by focus forming unit assay with Vero cells). After 1 hour of infection, cells were washed with citrate buffer to destroy virus remaining in the infection media that did not infect the cells. After 24 h, a plasmid expressing Lw C2c2/Cas13a fused to msfGFP with a nuclear export signal, and a plasmid expressing guide RNA was transfected into 293FT cells using Lipofectamine 2000. 48 h after infection, virus-containing supernatant was removed and diluted 1.10 in Nuclease-free water and then used as input for RT-qPCR with primers against LCMV GP. The results are shown in FIG. 69.

A plasmid expressing Lw C2c2/Cas13a fused to msfGFP with a nuclear export signal, and either a single plasmid or multiple plasmids expressing guide RNA(s) were transfected into 293FT cells using Lipofectamine 2000. 293FT cells were plated simultaneously to lipofectamine-plasmid mixture addition. Cells were transfected with 1 to 4 different guide RNAs. After 24 h, the cells were infected with LCMV Armstrong (MOI 5, 1 h) (viral titer was determined by focus forming unit assay with Vero cells). After 1 hour of infection, cells were washed with citrate buffer to destroy virus remaining in the infection media that did not infect the cells. 48 hours post infection, virus-containing supernatant was removed and diluted 1:10 in Nuclease-free water and then used as input for RT-qPCR with primers against LCMV GP. The results are shown in FIG. 70.

Figure 68:
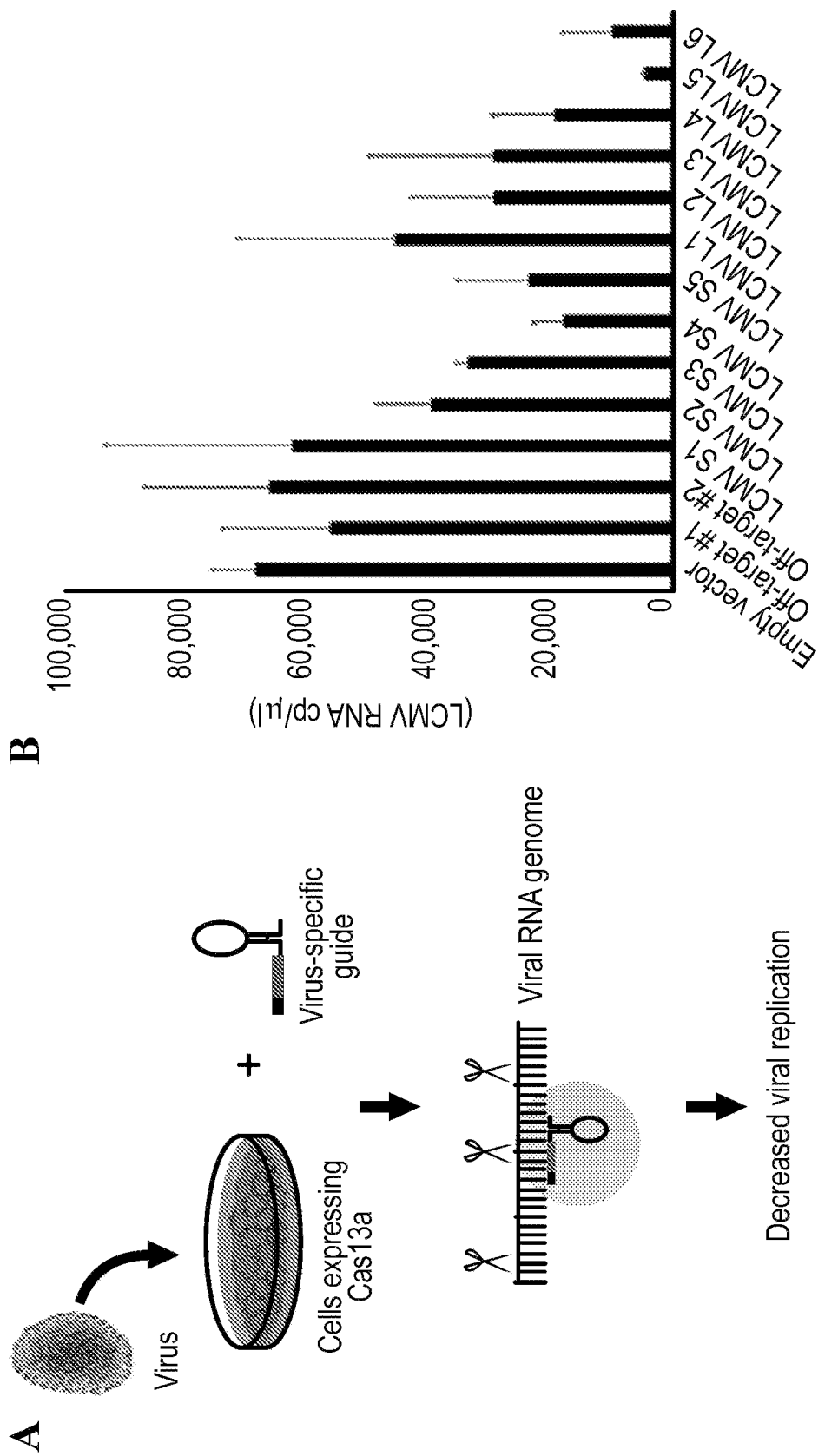
FIG. 68—Cas13a and LCMV-specific guide RNA expression decreases LCMV replication in cell culture. A) HEK293FT cells were transfected with plasmids expressing Cas13a and single guide RNAs targeting LCMV or non-targeting controls. 24 hours post-transfection, cells were infected with LCMV at an MOI of 5, and viral titers were measured 48 hours post-infection using RT-qPCR of viral RNA in the culture supernatant. B) Inhibition of viral replication. Empty vector, off-target #1 and off-target #2 are considered negative controls. S1-S5 and L1-L6 target various regions of the LCMV genome. Error bars indicate 1 standard deviation based on n=3-6 biological replicates.
Figure 69:
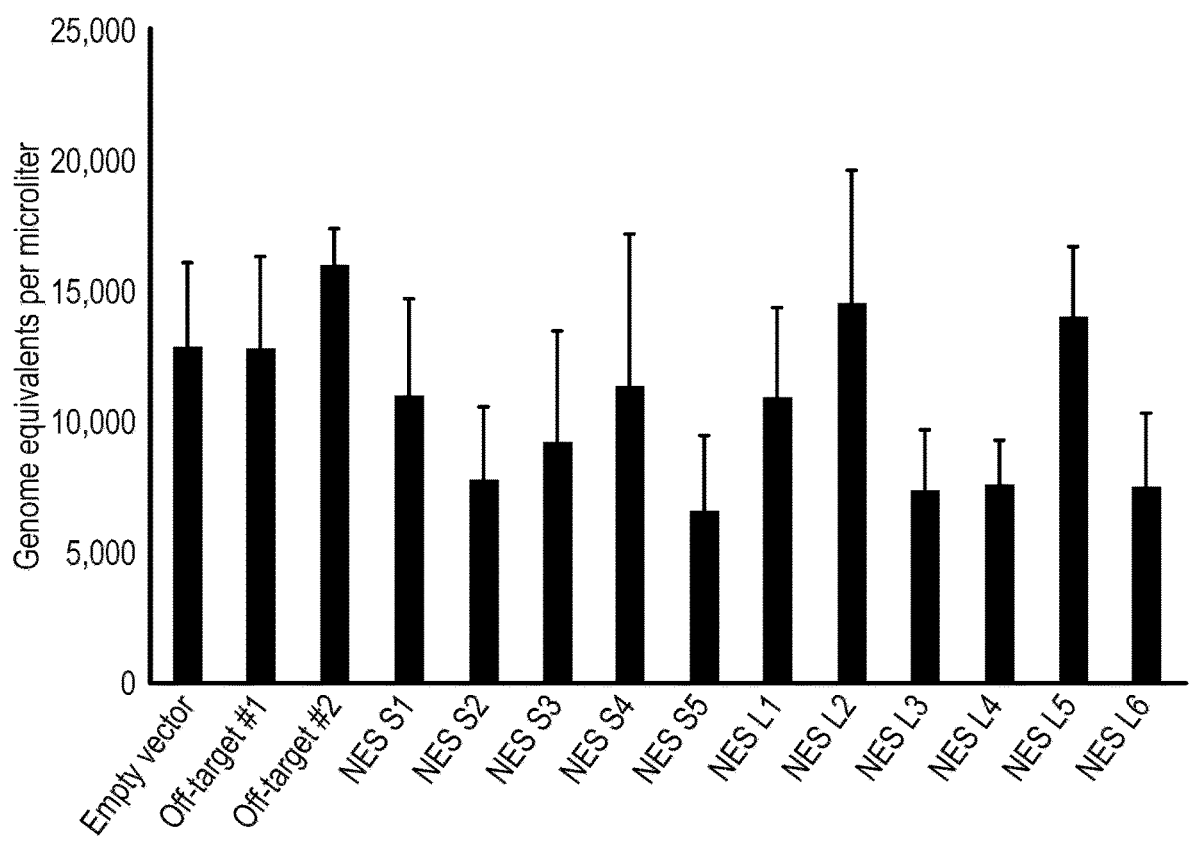
FIG. 69—Inhibition of viral replication. LCMV infected mammalian 293FT cells were transfected with the indicated C2c2 and guide plasmids. Plots represent RT-qPCR values as genome equivalents per microliter with a bar for each transfected guide plasmid. Empty vector, off-target #1 and off-target #2 are considered negative controls. S1-S5 and L1-L6 target various regions of the LCMV genome. Error bars indicate 1 standard deviation based on n=6 biological replicates.
Figure 70:
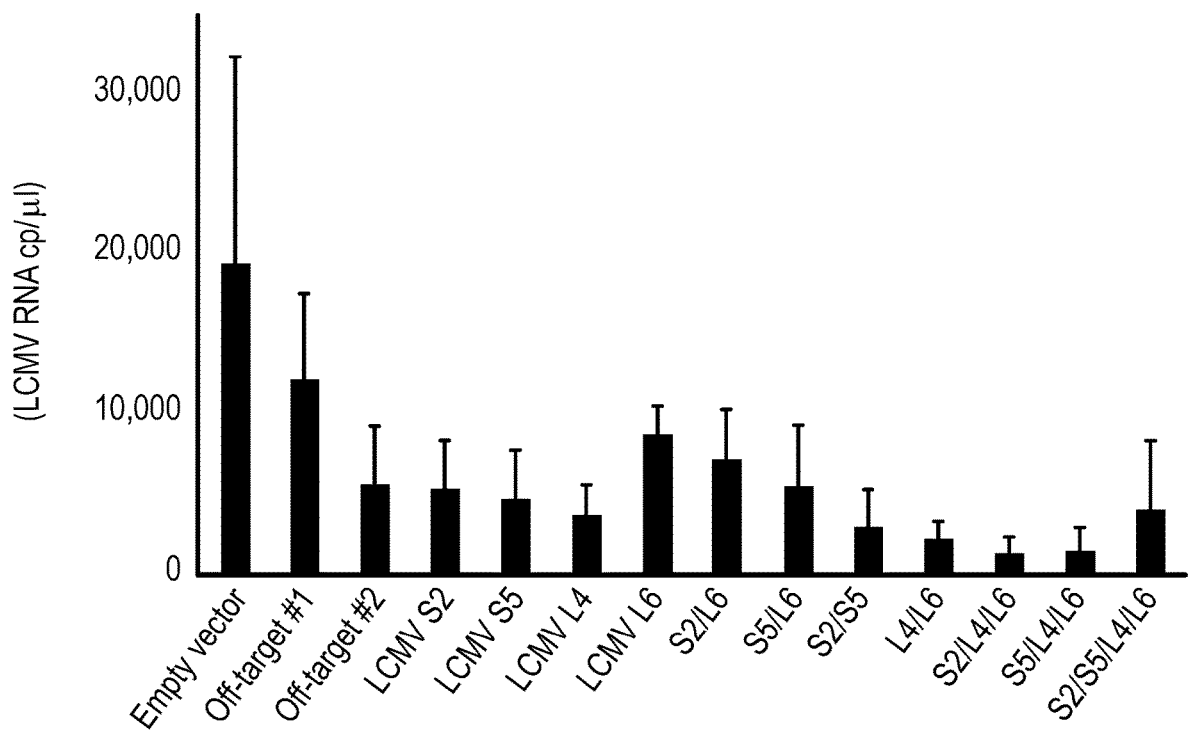
FIG. 70—combinations of multiple guides enhance the Cas13a-mediated inhibition of LCMV replication. HEK293FT cells were transfected with plasmids expressing Cas13a and one or more guide RNAs targeting LCMV or non-targeting controls. LCMV infection was performed 24 hours post-transfection at an MOI of 5, and viral titers were measured 48 hours post infection using RT-qPCR of viral RNA in the culture supernatant. Empty vector, off-target #1 and off-target #2 are considered negative controls. Error bars indicate one standard deviation based on n=6 biological replicates.

From FIGS. 68-70, it is clear that the CRISPR system designed to target viral RNA can reduce viral replication and thus viral load, which is even more pronounced when using multiple guide RNAs.

Example 4 Whole Genome Screen of LCMV for Cas13 Targeting Guides

A genome-wide screen was performed to identify the most efficient guide RNAs. 283 guide RNAs are tiled across the LCMV genome: every 50 nt on the coding strand (207 guides) and every 150 nt on the non-coding strand (76 guides).

LCMV Screen design and approach: To conduct a full-genome screen for guides that reduce LCMV replication guides were tiled across both the S and L segment of the LCMV genome. For coding regions, a 28 nt guide was designed every 50 nt along the coding region. For non-coding regions, guides were designed every 150 nt. There are 4 coding regions for LCMV for the four proteins (GPC, NP (or dN), Z and L) and each of these 4 proteins has their own non-coding region. With this strategy, 283 guides were tested total: GPC: 11 guides in the non-coding region and 32 guides in the coding region; NP: 12 guides in the non-coding region and 35 guides in the coding region; Z: 4 guides in the non-coding region and 7 guides in the coding region; L: 49 guides in the non-coding region and 133 guides in the coding region. The spacer sequences of the respective gRNAs, as well as their relative positions within the LCMV genome and LMCV genes are provided in Table 21 below.

TABLE 21

| | ID | Spacer sequence | | |
|---|---|---|---|---|
| 1 | L_targ_Z_Lsh/Lw2/Ca/LbFSL_1 | (SEQ ID NO: 636) | 1 | |
| 2 | L_targ_Z_Lsh/Lw2/Ca/LbFSL_2 | (SEQ ID NO: 637) | 2 | |
| 3 | L_targ_Z_Lsh/Lw2/Ca/LbFSL_3 | (SEQ ID NO: 638) | 3 | |
| 4 | L_targ_Z_Lsh/Lw2/Ca/LbFSL_4 | (SEQ ID NO: 639) | 4 | |
| 5 | L_targ_Z_Lsh/Lw2/Ca/LbFSL_5 | (SEQ ID NO: 640) | 5 | |
| 6 | L_targ_Z_Lsh/Lw2/Ca/LbFSL_6 | (SEQ ID NO: 641) | 6 | |
| 7 | L_targ_Z_Lsh/Lw2/Ca/LbFSL_7 | (SEQ ID NO: 642) | 7 | |
| 1 | L_targ_L_Lsh/Lw2/Ca/LbFSL_1 | (SEQ ID NO: 643) | 8 | START OF L |
| 2 | L_targ_L_Lsh/Lw2/Ca/LbFSL_2 | (SEQ ID NO: 644) | 9 | |
| 3 | L_targ_L_Lsh/Lw2/Ca/LbFSL_3 | (SEQ ID NO: 645) | 10 | |
| 4 | L_targ_L_Lsh/Lw2/Ca/LbFSL_4 | (SEQ ID NO: 646) | 11 | |
| 5 | L_targ_L_Lsh/Lw2/Ca/LbFSL_5 | (SEQ ID NO: 647) | 12 | |
| 6 | L_targ_L_Lsh/Lw2/Ca/LbFSL_6 | (SEQ ID NO: 648) | 13 | |
| 7 | L_targ_L_Lsh/Lw2/Ca/LbFSL_7 | (SEQ ID NO: 649) | 14 | |
| 8 | L_targ_L_Lsh/Lw2/Ca/LbFSL_8 | (SEQ ID NO: 650) | 15 | |

TABLE 21-continued

| | ID | Spacer sequence | |
|---|---|---|---|
| 9 | L_targ_L_Lsh/Lw2/Ca/LbFSL_9 | (SEQ ID NO: 651) | 16 |
| 10 | L_targ_L_Lsh/Lw2/Ca/LbFSL_10 | (SEQ ID NO: 652) | 17 |
| 11 | L_targ_L_Lsh/Lw2/Ca/LbFSL_11 | (SEQ ID NO: 653) | 18 |
| 12 | L_targ_L_Lsh/Lw2/Ca/LbFSL_12 | (SEQ ID NO: 654) | 19 |
| 13 | L_targ_L_Lsh/Lw2/Ca/LbFSL_13 | (SEQ ID NO: 655) | 20 |
| 14 | L_targ_L_Lsh/Lw2/Ca/LbFSL_14 | (SEQ ID NO: 656) | 21 |
| 15 | L_targ_L_Lsh/Lw2/Ca/LbFSL_15 | (SEQ ID NO: 657) | 22 |
| 16 | L_targ_L_Lsh/Lw2/Ca/LbFSL_16 | (SEQ ID NO: 658) | 23 |
| 17 | L_targ_L_Lsh/Lw2/Ca/LbFSL_17 | (SEQ ID NO: 659) | 24 |
| 18 | L_targ_L_Lsh/Lw2/Ca/LbFSL_18 | (SEQ ID NO: 660) | 25 |
| 19 | L_targ_L_Lsh/Lw2/Ca/LbFSL_19 | (SEQ ID NO: 661) | 26 |
| 20 | L_targ_L_Lsh/Lw2/Ca/LbFSL_20 | (SEQ ID NO: 662) | 27 |
| 21 | L_targ_L_Lsh/Lw2/Ca/LbFSL_21 | (SEQ ID NO: 663) | 28 |
| 22 | L_targ_L_Lsh/Lw2/Ca/LbFSL_22 | (SEQ ID NO: 664) | 29 |
| 23 | L_targ_L_Lsh/Lw2/Ca/LbFSL_23 | (SEQ ID NO: 665) | 30 |
| 24 | L_targ_L_Lsh/Lw2/Ca/LbFSL_24 | (SEQ ID NO: 666) | 31 |
| 25 | L_targ_L_Lsh/Lw2/Ca/LbFSL_25 | (SEQ ID NO: 667) | 32 |
| 26 | L_targ_L_Lsh/Lw2/Ca/LbFSL_26 | (SEQ ID NO: 668) | 33 |
| 27 | L_targ_L_Lsh/Lw2/Ca/LbFSL_27 | (SEQ ID NO: 669) | 34 |
| 28 | L_targ_L_Lsh/Lw2/Ca/LbFSL_28 | (SEQ ID NO: 670) | 35 |
| 29 | L_targ_L_Lsh/Lw2/Ca/LbFSL_29 | (SEQ ID NO: 671) | 36 |
| 30 | L_targ_L_Lsh/Lw2/Ca/LbFSL_30 | (SEQ ID NO: 672) | 37 |
| 31 | L_targ_L_Lsh/Lw2/Ca/LbFSL_31 | (SEQ ID NO: 673) | 38 |
| 32 | L_targ_L_Lsh/Lw2/Ca/LbFSL_32 | (SEQ ID NO: 674) | 39 |
| 33 | L_targ_L_Lsh/Lw2/Ca/LbFSL_33 | (SEQ ID NO: 675) | 40 |
| 34 | L_targ_L_Lsh/Lw2/Ca/LbFSL_34 | (SEQ ID NO: 676) | 41 |
| 35 | L_targ_L_Lsh/Lw2/Ca/LbFSL_35 | (SEQ ID NO: 677) | 42 |
| 36 | L_targ_L_Lsh/Lw2/Ca/LbFSL_36 | (SEQ ID NO: 678) | 43 |
| 37 | L_targ_L_Lsh/Lw2/Ca/LbFSL_37 | (SEQ ID NO: 679) | 44 |
| 38 | L_targ_L_Lsh/Lw2/Ca/LbFSL_38 | (SEQ ID NO: 680) | 45 |
| 39 | L_targ_L_Lsh/Lw2/Ca/LbFSL_39 | (SEQ ID NO: 681) | 46 |
| 40 | L_targ_L_Lsh/Lw2/Ca/LbFSL_40 | (SEQ ID NO: 682) | 47 |
| 41 | L_targ_L_Lsh/Lw2/Ca/LbFSL_41 | (SEQ ID NO: 683) | 48 |
| 42 | L_targ_L_Lsh/Lw2/Ca/LbFSL_42 | (SEQ ID NO: 684) | 49 |
| 43 | L_targ_L_Lsh/Lw2/Ca/LbFSL_43 | (SEQ ID NO: 685) | 50 |
| 44 | L_targ_L_Lsh/Lw2/Ca/LbFSL_44 | (SEQ ID NO: 686) | 51 |
| 45 | L_targ_L_Lsh/Lw2/Ca/LbFSL_45 | (SEQ ID NO: 687) | 52 |
| 46 | L_targ_L_Lsh/Lw2/Ca/LbFSL_46 | (SEQ ID NO: 688) | 53 |
| 47 | L_targ_L_Lsh/Lw2/Ca/LbFSL_47 | (SEQ ID NO: 689) | 54 |
| 48 | L_targ_L_Lsh/Lw2/Ca/LbFSL_48 | (SEQ ID NO: 690) | 55 |
| 49 | L_targ_L_Lsh/Lw2/Ca/LbFSL_49 | (SEQ ID NO: 691) | 56 |
| 50 | L_targ_L_Lsh/Lw2/Ca/LbFSL_50 | (SEQ ID NO: 692) | 57 |
| 51 | L_targ_L_Lsh/Lw2/Ca/LbFSL_51 | (SEQ ID NO: 693) | 58 |
| 52 | L_targ_L_Lsh/Lw2/Ca/LbFSL_52 | (SEQ ID NO: 694) | 59 |
| 53 | L_targ_L_Lsh/Lw2/Ca/LbFSL_53 | (SEQ ID NO: 695) | 60 |
| 54 | L_targ_L_Lsh/Lw2/Ca/LbFSL_54 | (SEQ ID NO: 696) | 61 |
| 55 | L_targ_L_Lsh/Lw2/Ca/LbFSL_55 | (SEQ ID NO: 697) | 62 |
| 56 | L_targ_L_Lsh/Lw2/Ca/LbFSL_56 | (SEQ ID NO: 698) | 63 |
| 57 | L_targ_L_Lsh/Lw2/Ca/LbFSL_57 | (SEQ ID NO: 699) | 64 |
| 58 | L_targ_L_Lsh/Lw2/Ca/LbFSL_58 | (SEQ ID NO: 700) | 65 |
| 59 | L_targ_L_Lsh/Lw2/Ca/LbFSL_59 | (SEQ ID NO: 701) | 66 |
| 60 | L_targ_L_Lsh/Lw2/Ca/LbFSL_60 | (SEQ ID NO: 702) | 67 |
| 61 | L_targ_L_Lsh/Lw2/Ca/LbFSL_61 | (SEQ ID NO: 703) | 68 |
| 62 | L_targ_L_Lsh/Lw2/Ca/LbFSL_62 | (SEQ ID NO: 704) | 69 |
| 63 | L_targ_L_Lsh/Lw2/Ca/LbFSL_63 | (SEQ ID NO: 705) | 70 |
| 64 | L_targ_L_Lsh/Lw2/Ca/LbFSL_64 | (SEQ ID NO: 706) | 71 |
| 65 | L_targ_L_Lsh/Lw2/Ca/LbFSL_65 | (SEQ ID NO: 707) | 72 |
| 66 | L_targ_L_Lsh/Lw2/Ca/LbFSL_66 | (SEQ ID NO: 708) | 73 |
| 67 | L_targ_L_Lsh/Lw2/Ca/LbFSL_67 | (SEQ ID NO: 709) | 74 |
| 68 | L_targ_L_Lsh/Lw2/Ca/LbFSL_68 | (SEQ ID NO: 710) | 75 |
| 69 | L_targ_L_Lsh/Lw2/Ca/LbFSL_69 | (SEQ ID NO: 711) | 76 |
| 70 | L_targ_L_Lsh/Lw2/Ca/LbFSL_70 | (SEQ ID NO: 712) | 77 |
| 71 | L_targ_L_Lsh/Lw2/Ca/LbFSL_71 | (SEQ ID NO: 713) | 78 |
| 72 | L_targ_L_Lsh/Lw2/Ca/LbFSL_72 | (SEQ ID NO: 714) | 79 |
| 73 | L_targ_L_Lsh/Lw2/Ca/LbFSL_73 | (SEQ ID NO: 715) | 80 |
| 74 | L_targ_L_Lsh/Lw2/Ca/LbFSL_74 | (SEQ ID NO: 716) | 81 |
| 75 | L_targ_L_Lsh/Lw2/Ca/LbFSL_75 | (SEQ ID NO: 717) | 82 |
| 76 | L_targ_L_Lsh/Lw2/Ca/LbFSL_76 | (SEQ ID NO: 718) | 83 |
| 77 | L_targ_L_Lsh/Lw2/Ca/LbFSL_77 | (SEQ ID NO: 719) | 84 |
| 78 | L_targ_L_Lsh/Lw2/Ca/LbFSL_78 | (SEQ ID NO: 720) | 85 |
| 79 | L_targ_L_Lsh/Lw2/Ca/LbFSL_79 | (SEQ ID NO: 721) | 86 |
| 80 | L_targ_L_Lsh/Lw2/Ca/LbFSL_80 | (SEQ ID NO: 722) | 87 |
| 81 | L_targ_L_Lsh/Lw2/Ca/LbFSL_81 | (SEQ ID NO: 723) | 88 |
| 82 | L_targ_L_Lsh/Lw2/Ca/LbFSL_82 | (SEQ ID NO: 724) | 89 |
| 83 | L_targ_L_Lsh/Lw2/Ca/LbFSL_83 | (SEQ ID NO: 725) | 90 |
| 84 | L_targ_L_Lsh/Lw2/Ca/LbFSL_84 | (SEQ ID NO: 726) | 91 |
| 85 | L_targ_L_Lsh/Lw2/Ca/LbFSL_85 | (SEQ ID NO: 727) | 92 |
| 86 | L_targ_L_Lsh/Lw2/Ca/LbFSL_86 | (SEQ ID NO: 728) | 93 |

TABLE 21-continued

| | ID | Spacer sequence | | |
|---|---|---|---|---|
| 87 | L_targ_L_Lsh/Lw2/Ca/LbFSL_87 | (SEQ ID NO: 729) | 94 | |
| 88 | L_targ_L_Lsh/Lw2/Ca/LbFSL_88 | (SEQ ID NO: 730) | 95 | |
| 89 | L_targ_L_Lsh/Lw2/Ca/LbFSL_89 | (SEQ ID NO: 731) | 96 | |
| 90 | L_targ_L_Lsh/Lw2/Ca/LbFSL_90 | (SEQ ID NO: 732) | 97 | |
| 91 | L_targ_L_Lsh/Lw2/Ca/LbFSL_91 | (SEQ ID NO: 733) | 98 | |
| 92 | L_targ_L_Lsh/Lw2/Ca/LbFSL_92 | (SEQ ID NO: 734) | 99 | |
| 93 | L_targ_L_Lsh/Lw2/Ca/LbFSL_93 | (SEQ ID NO: 735) | 100 | |
| 94 | L_targ_L_Lsh/Lw2/Ca/LbFSL_94 | (SEQ ID NO: 736) | 101 | |
| 95 | L_targ_L_Lsh/Lw2/Ca/LbFSL_95 | (SEQ ID NO: 737) | 102 | |
| 96 | L_targ_L_Lsh/Lw2/Ca/LbFSL_96 | (SEQ ID NO: 738) | 103 | |
| 97 | L_targ_L_Lsh/Lw2/Ca/LbFSL_97 | (SEQ ID NO: 739) | 104 | |
| 98 | L_targ_L_Lsh/Lw2/Ca/LbFSL_98 | (SEQ ID NO: 740) | 105 | |
| 99 | L_targ_L_Lsh/Lw2/Ca/LbFSL_99 | (SEQ ID NO: 741) | 106 | |
| 100 | L_targ_L_Lsh/Lw2/Ca/LbFSL_100 | (SEQ ID NO: 742) | 107 | |
| 101 | L_targ_L_Lsh/Lw2/Ca/LbFSL_101 | (SEQ ID NO: 743) | 108 | |
| 102 | L_targ_L_Lsh/Lw2/Ca/LbFSL_102 | (SEQ ID NO: 744) | 109 | |
| 103 | L_targ_L_Lsh/Lw2/Ca/LbFSL_103 | (SEQ ID NO: 745) | 110 | |
| 104 | L_targ_L_Lsh/Lw2/Ca/LbFSL_104 | (SEQ ID NO: 746) | 111 | |
| 105 | L_targ_L_Lsh/Lw2/Ca/LbFSL_105 | (SEQ ID NO: 747) | 112 | |
| 106 | L_targ_L_Lsh/Lw2/Ca/LbFSL_106 | (SEQ ID NO: 748) | 113 | |
| 107 | L_targ_L_Lsh/Lw2/Ca/LbFSL_107 | (SEQ ID NO: 749) | 114 | |
| 108 | L_targ_L_Lsh/Lw2/Ca/LbFSL_108 | (SEQ ID NO: 750) | 115 | |
| 109 | L_targ_L_Lsh/Lw2/Ca/LbFSL_109 | (SEQ ID NO: 751) | 116 | |
| 110 | L_targ_L_Lsh/Lw2/Ca/LbFSL_110 | (SEQ ID NO: 752) | 117 | |
| 111 | L_targ_L_Lsh/Lw2/Ca/LbFSL_111 | (SEQ ID NO: 753) | 118 | |
| 112 | L_targ_L_Lsh/Lw2/Ca/LbFSL_112 | (SEQ ID NO: 754) | 119 | |
| 113 | L_targ_L_Lsh/Lw2/Ca/LbFSL_113 | (SEQ ID NO: 755) | 120 | |
| 114 | L_targ_L_Lsh/Lw2/Ca/LbFSL_114 | (SEQ ID NO: 756) | 121 | |
| 115 | L_targ_L_Lsh/Lw2/Ca/LbFSL_115 | (SEQ ID NO: 757) | 122 | |
| 116 | L_targ_L_Lsh/Lw2/Ca/LbFSL_116 | (SEQ ID NO: 758) | 123 | |
| 117 | L_targ_L_Lsh/Lw2/Ca/LbFSL_117 | (SEQ ID NO: 759) | 124 | |
| 118 | L_targ_L_Lsh/Lw2/Ca/LbFSL_118 | (SEQ ID NO: 760) | 125 | |
| 119 | L_targ_L_Lsh/Lw2/Ca/LbFSL_119 | (SEQ ID NO: 761) | 126 | |
| 120 | L_targ_L_Lsh/Lw2/Ca/LbFSL_120 | (SEQ ID NO: 762) | 127 | |
| 121 | L_targ_L_Lsh/Lw2/Ca/LbFSL_121 | (SEQ ID NO: 763) | 128 | |
| 122 | L_targ_L_Lsh/Lw2/Ca/LbFSL_122 | (SEQ ID NO: 764) | 129 | |
| 123 | L_targ_L_Lsh/Lw2/Ca/LbFSL_123 | (SEQ ID NO: 765) | 130 | |
| 124 | L_targ_L_Lsh/Lw2/Ca/LbFSL_124 | (SEQ ID NO: 766) | 131 | |
| 125 | L_targ_L_Lsh/Lw2/Ca/LbFSL_125 | (SEQ ID NO: 767) | 132 | |
| 126 | L_targ_L_Lsh/Lw2/Ca/LbFSL_126 | (SEQ ID NO: 768) | 133 | |
| 127 | L_targ_L_Lsh/Lw2/Ca/LbFSL_127 | (SEQ ID NO: 769) | 134 | |
| 128 | L_targ_L_Lsh/Lw2/Ca/LbFSL_128 | (SEQ ID NO: 770) | 135 | |
| 129 | L_targ_L_Lsh/Lw2/Ca/LbFSL_129 | (SEQ ID NO: 771) | 136 | |
| 130 | L_targ_L_Lsh/Lw2/Ca/LbFSL_130 | (SEQ ID NO: 772) | 137 | |
| 131 | L_targ_L_Lsh/Lw2/Ca/LbFSL_131 | (SEQ ID NO: 773) | 138 | |
| 132 | L_targ_L_Lsh/Lw2/Ca/LbFSL_132 | (SEQ ID NO: 774) | 139 | |
| 133 | L_targ_L_Lsh/Lw2/Ca/LbFSL_133 | (SEQ ID NO: 775) | 140 | START OF GPC |
| 1 | S_targ_GPC_Lsh/Lw2/Ca/LbFSL_1 | (SEQ ID NO: 776) | 141 | |
| 2 | S_targ_GPC_Lsh/Lw2/Ca/LbFSL_2 | (SEQ ID NO: 777) | 142 | |
| 3 | S_targ_GPC_Lsh/Lw2/Ca/LbFSL_3 | (SEQ ID NO: 778) | 143 | |
| 4 | S_targ_GPC_Lsh/Lw2/Ca/LbFSL_4 | (SEQ ID NO: 779) | 144 | |
| 5 | S_targ_GPC_Lsh/Lw2/Ca/LbFSL_5 | (SEQ ID NO: 780) | 145 | |
| 6 | S_targ_GPC_Lsh/Lw2/Ca/LbFSL_6 | (SEQ ID NO: 781) | 146 | |
| 7 | S_targ_GPC_Lsh/Lw2/Ca/LbFSL_7 | (SEQ ID NO: 782) | 147 | |
| 8 | S_targ_GPC_Lsh/Lw2/Ca/LbFSL_8 | (SEQ ID NO: 783) | 148 | |
| 9 | S_targ_GPC_Lsh/Lw2/Ca/LbFSL_9 | (SEQ ID NO: 784) | 149 | |
| 10 | S_targ_GPC_Lsh/Lw2/Ca/LbFSL_10 | (SEQ ID NO: 785) | 150 | |
| 11 | S_targ_GPC_Lsh/Lw2/Ca/LbFSL_11 | (SEQ ID NO: 786) | 151 | |
| 12 | S_targ_GPC_Lsh/Lw2/Ca/LbFSL_12 | (SEQ ID NO: 787) | 152 | |
| 13 | S_targ_GPC_Lsh/Lw2/Ca/LbFSL_13 | (SEQ ID NO: 788) | 153 | |
| 14 | S_targ_GPC_Lsh/Lw2/Ca/LbFSL_14 | (SEQ ID NO: 789) | 154 | |
| 15 | S_targ_GPC_Lsh/Lw2/Ca/LbFSL_15 | (SEQ ID NO: 790) | 155 | |
| 16 | S_targ_GPC_Lsh/Lw2/Ca/LbFSL_16 | (SEQ ID NO: 791) | 156 | |
| 17 | S_targ_GPC_Lsh/Lw2/Ca/LbFSL_17 | (SEQ ID NO: 792) | 157 | |
| 18 | S_targ_GPC_Lsh/Lw2/Ca/LbFSL_18 | (SEQ ID NO: 793) | 158 | |
| 19 | S_targ_GPC_Lsh/Lw2/Ca/LbFSL_19 | (SEQ ID NO: 794) | 159 | |
| 20 | S_targ_GPC_Lsh/Lw2/Ca/LbFSL_20 | (SEQ ID NO: 795) | 160 | |
| 21 | S_targ_GPC_Lsh/Lw2/Ca/LbFSL_21 | (SEQ ID NO: 796) | 161 | |
| 22 | S_targ_GPC_Lsh/Lw2/Ca/LbFSL_22 | (SEQ ID NO: 797) | 162 | |
| 23 | S_targ_GPC_Lsh/Lw2/Ca/LbFSL_23 | (SEQ ID NO: 798) | 163 | |
| 24 | S_targ_GPC_Lsh/Lw2/Ca/LbFSL_24 | (SEQ ID NO: 799) | 164 | |
| 25 | S_targ_GPC_Lsh/Lw2/Ca/LbFSL_25 | (SEQ ID NO: 800) | 165 | |
| 26 | S_targ_GPC_Lsh/Lw2/Ca/LbFSL_26 | (SEQ ID NO: 801) | 166 | |
| 27 | S_targ_GPC_Lsh/Lw2/Ca/LbFSL_27 | (SEQ ID NO: 802) | 167 | |
| 28 | S_targ_GPC_Lsh/Lw2/Ca/LbFSL_28 | (SEQ ID NO: 803) | 168 | |
| 29 | S_targ_GPC_Lsh/Lw2/Ca/LbFSL_29 | (SEQ ID NO: 804) | 169 | |
| 30 | S_targ_GPC_Lsh/Lw2/Ca/LbFSL_30 | (SEQ ID NO: 805) | 170 | |
| 31 | S_targ_GPC_Lsh/Lw2/Ca/LbFSL_31 | (SEQ ID NO: 806) | 171 | |

TABLE 21-continued

| | ID | Spacer sequence | | |
|---|---|---|---|---|
| 32 | S_targ_GPC_Lsh/Lw2/Ca/LbFSL_32 | (SEQ ID NO: 807) | 172 | START OF NP |
| 1 | S_targ_NP_Lsh/Lw2/Ca/LbFSL_1 | (SEQ ID NO: 808) | 173 | |
| 2 | S_targ_NP_Lsh/Lw2/Ca/LbFSL_2 | (SEQ ID NO: 809) | 174 | |
| 3 | S_targ_NP_Lsh/Lw2/Ca/LbFSL_3 | (SEQ ID NO: 810) | 175 | |
| 4 | S_targ_NP_Lsh/Lw2/Ca/LbFSL_4 | (SEQ ID NO: 811) | 176 | |
| 5 | S_targ_NP_Lsh/Lw2/Ca/LbFSL_5 | (SEQ ID NO: 812) | 177 | |
| 6 | S_targ_NP_Lsh/Lw2/Ca/LbFSL_6 | (SEQ ID NO: 813) | 178 | |
| 7 | S_targ_NP_Lsh/Lw2/Ca/LbFSL_7 | (SEQ ID NO: 814) | 179 | |
| 8 | S_targ_NP_Lsh/Lw2/Ca/LbFSL_8 | (SEQ ID NO: 815) | 180 | |
| 9 | S_targ_NP_Lsh/Lw2/Ca/LbFSL_9 | (SEQ ID NO: 816) | 181 | |
| 10 | S_targ_NP_Lsh/Lw2/Ca/LbFSL_10 | (SEQ ID NO: 817) | 182 | |
| 11 | S_targ_NP_Lsh/Lw2/Ca/LbFSL_11 | (SEQ ID NO: 818) | 183 | |
| 12 | S_targ_NP_Lsh/Lw2/Ca/LbFSL_12 | (SEQ ID NO: 819) | 184 | |
| 13 | S_targ_NP_Lsh/Lw2/Ca/LbFSL_13 | (SEQ ID NO: 820) | 185 | |
| 14 | S_targ_NP_Lsh/Lw2/Ca/LbFSL_14 | (SEQ ID NO: 821) | 186 | |
| 15 | S_targ_NP_Lsh/Lw2/Ca/LbFSL_15 | (SEQ ID NO: 822) | 187 | |
| 16 | S_targ_NP_Lsh/Lw2/Ca/LbFSL_16 | (SEQ ID NO: 823) | 188 | |
| 17 | S_targ_NP_Lsh/Lw2/Ca/LbFSL_17 | (SEQ ID NO: 824) | 189 | |
| 18 | S_targ_NP_Lsh/Lw2/Ca/LbFSL_18 | (SEQ ID NO: 825) | 190 | |
| 19 | S_targ_NP_Lsh/Lw2/Ca/LbFSL_19 | (SEQ ID NO: 826) | 191 | |
| 20 | S_targ_NP_Lsh/Lw2/Ca/LbFSL_20 | (SEQ ID NO: 827) | 192 | |
| 21 | S_targ_NP_Lsh/Lw2/Ca/LbFSL_21 | (SEQ ID NO: 828) | 193 | |
| 22 | S_targ_NP_Lsh/Lw2/Ca/LbFSL_22 | (SEQ ID NO: 829) | 194 | |
| 23 | S_targ_NP_Lsh/Lw2/Ca/LbFSL_23 | (SEQ ID NO: 830) | 195 | |
| 24 | S_targ_NP_Lsh/Lw2/Ca/LbFSL_24 | (SEQ ID NO: 831) | 196 | |
| 25 | S_targ_NP_Lsh/Lw2/Ca/LbFSL_25 | (SEQ ID NO: 832) | 197 | |
| 26 | S_targ_NP_Lsh/Lw2/Ca/LbFSL_26 | (SEQ ID NO: 833) | 198 | |
| 27 | S_targ_NP_Lsh/Lw2/Ca/LbFSL_27 | (SEQ ID NO: 834) | 199 | |
| 28 | S_targ_NP_Lsh/Lw2/Ca/LbFSL_28 | (SEQ ID NO: 835) | 200 | |
| 29 | S_targ_NP_Lsh/Lw2/Ca/LbFSL_29 | (SEQ ID NO: 836) | 201 | |
| 30 | S_targ_NP_Lsh/Lw2/Ca/LbFSL_30 | (SEQ ID NO: 837) | 202 | |
| 31 | S_targ_NP_Lsh/Lw2/Ca/LbFSL_31 | (SEQ ID NO: 838) | 203 | |
| 32 | S_targ_NP_Lsh/Lw2/Ca/LbFSL_32 | (SEQ ID NO: 839) | 204 | |
| 33 | S_targ_NP_Lsh/Lw2/Ca/LbFSL_33 | (SEQ ID NO: 840) | 205 | |
| 34 | S_targ_NP_Lsh/Lw2/Ca/LbFSL_34 | (SEQ ID NO: 841) | 206 | |
| 35 | S_targ_NP_Lsh/Lw2/Ca/LbFSL_35 | (SEQ ID NO: 842) | 207 | |
| 1 | L_targ_Znc_Lsh/Lw2/Ca/LbFSL_1 | (SEQ ID NO: 843) | 208 | START OF Znc |
| 2 | L_targ_Znc_Lsh/Lw2/Ca/LbFSL_2 | (SEQ ID NO: 844) | 209 | |
| 3 | L_targ_Znc_Lsh/Lw2/Ca/LbFSL_3 | (SEQ ID NO: 845) | 210 | |
| 4 | L_targ_Znc_Lsh/Lw2/Ca/LbFSL_4 | (SEQ ID NO: 846) | 211 | |
| 1 | L_targ_Lnc_Lsh/Lw2/Ca/LbFSL_1 | (SEQ ID NO: 847) | 212 | START of Lnc |
| 2 | L_targ_Lnc_Lsh/Lw2/Ca/LbFSL_2 | (SEQ ID NO: 848) | 213 | |
| 3 | L_targ_Lnc_Lsh/Lw2/Ca/LbFSL_3 | (SEQ ID NO: 849) | 214 | |
| 4 | L_targ_Lnc_Lsh/Lw2/Ca/LbFSL_4 | (SEQ ID NO: 850) | 215 | |
| 5 | L_targ_Lnc_Lsh/Lw2/Ca/LbFSL_5 | (SEQ ID NO: 851) | 216 | |
| 6 | L_targ_Lnc_Lsh/Lw2/Ca/LbFSL_6 | (SEQ ID NO: 852) | 217 | |
| 7 | L_targ_Lnc_Lsh/Lw2/Ca/LbFSL_7 | (SEQ ID NO: 853) | 218 | |
| 8 | L_targ_Lnc_Lsh/Lw2/Ca/LbFSL_8 | (SEQ ID NO: 854) | 219 | |
| 9 | L_targ_Lnc_Lsh/Lw2/Ca/LbFSL_9 | (SEQ ID NO: 855) | 220 | |
| 10 | L_targ_Lnc_Lsh/Lw2/Ca/LbFSL_10 | (SEQ ID NO: 856) | 221 | |
| 11 | L_targ_Lnc_Lsh/Lw2/Ca/LbFSL_11 | (SEQ ID NO: 857) | 222 | |
| 12 | L_targ_Lnc_Lsh/Lw2/Ca/LbFSL_12 | (SEQ ID NO: 858) | 223 | |
| 13 | L_targ_Lnc_Lsh/Lw2/Ca/LbFSL_13 | (SEQ ID NO: 859) | 224 | |
| 14 | L_targ_Lnc_Lsh/Lw2/Ca/LbFSL_14 | (SEQ ID NO: 860) | 225 | |
| 15 | L_targ_Lnc_Lsh/Lw2/Ca/LbFSL_15 | (SEQ ID NO: 861) | 226 | |
| 16 | L_targ_Lnc_Lsh/Lw2/Ca/LbFSL_16 | (SEQ ID NO: 862) | 227 | |
| 17 | L_targ_Lnc_Lsh/Lw2/Ca/LbFSL_17 | (SEQ ID NO: 863) | 228 | |
| 18 | L_targ_Lnc_Lsh/Lw2/Ca/LbFSL_18 | (SEQ ID NO: 864) | 229 | |
| 19 | L_targ_Lnc_Lsh/Lw2/Ca/LbFSL_19 | (SEQ ID NO: 865) | 230 | |
| 20 | L_targ_Lnc_Lsh/Lw2/Ca/LbFSL_20 | (SEQ ID NO: 866) | 231 | |
| 21 | L_targ_Lnc_Lsh/Lw2/Ca/LbFSL_21 | (SEQ ID NO: 867) | 232 | |
| 22 | L_targ_Lnc_Lsh/Lw2/Ca/LbFSL_22 | (SEQ ID NO: 868) | 233 | |
| 23 | L_targ_Lnc_Lsh/Lw2/Ca/LbFSL_23 | (SEQ ID NO: 869) | 234 | |
| 24 | L_targ_Lnc_Lsh/Lw2/Ca/LbFSL_24 | (SEQ ID NO: 870) | 235 | |
| 25 | L_targ_Lnc_Lsh/Lw2/Ca/LbFSL_25 | (SEQ ID NO: 871) | 236 | |
| 26 | L_targ_Lnc_Lsh/Lw2/Ca/LbFSL_26 | (SEQ ID NO: 872) | 237 | |
| 27 | L_targ_Lnc_Lsh/Lw2/Ca/LbFSL_27 | (SEQ ID NO: 873) | 238 | |
| 28 | L_targ_Lnc_Lsh/Lw2/Ca/LbFSL_28 | (SEQ ID NO: 874) | 239 | |
| 29 | L_targ_Lnc_Lsh/Lw2/Ca/LbFSL_29 | (SEQ ID NO: 875) | 240 | |
| 30 | L_targ_Lnc_Lsh/Lw2/Ca/LbFSL_30 | (SEQ ID NO: 876) | 241 | |
| 31 | L_targ_Lnc_Lsh/Lw2/Ca/LbFSL_31 | (SEQ ID NO: 877) | 242 | |
| 32 | L_targ_Lnc_Lsh/Lw2/Ca/LbFSL_32 | (SEQ ID NO: 878) | 243 | |
| 33 | L_targ_Lnc_Lsh/Lw2/Ca/LbFSL_33 | (SEQ ID NO: 879) | 244 | |
| 34 | L_targ_Lnc_Lsh/Lw2/Ca/LbFSL_34 | (SEQ ID NO: 880) | 245 | |
| 35 | L_targ_Lnc_Lsh/Lw2/Ca/LbFSL_35 | (SEQ ID NO: 881) | 246 | |
| 36 | L_targ_Lnc_Lsh/Lw2/Ca/LbFSL_36 | (SEQ ID NO: 882) | 247 | |
| 37 | L_targ_Lnc_Lsh/Lw2/Ca/LbFSL_37 | (SEQ ID NO: 883) | 248 | |
| 38 | L_targ_Lnc_Lsh/Lw2/Ca/LbFSL_38 | (SEQ ID NO: 884) | 249 | |

TABLE 21-continued

| ID | | Spacer sequence | | |
|---|---|---|---|---|
| 39 | L_targ_Lnc_Lsh/Lw2/Ca/LbFSL_39 | (SEQ ID NO: 885) | 250 | |
| 40 | L_targ_Lnc_Lsh/Lw2/Ca/LbFSL_40 | (SEQ ID NO: 886) | 251 | |
| 41 | L_targ_Lnc_Lsh/Lw2/Ca/LbFSL_41 | (SEQ ID NO: 887) | 252 | |
| 42 | L_targ_Lnc_Lsh/Lw2/Ca/LbFSL_42 | (SEQ ID NO: 888) | 253 | |
| 43 | L_targ_Lnc_Lsh/Lw2/Ca/LbFSL_43 | (SEQ ID NO: 889) | 254 | |
| 44 | L_targ_Lnc_Lsh/Lw2/Ca/LbFSL_44 | (SEQ ID NO: 890) | 255 | |
| 45 | L_targ_Lnc_Lsh/Lw2/Ca/LbFSL_45 | (SEQ ID NO: 891) | 256 | |
| 46 | L_targ_Lnc_Lsh/Lw2/Ca/LbFSL_46 | (SEQ ID NO: 892) | 257 | |
| 47 | L_targ_Lnc_Lsh/Lw2/Ca/LbFSL_47 | (SEQ ID NO: 893) | 258 | |
| 48 | L_targ_Lnc_Lsh/Lw2/Ca/LbFSL_48 | (SEQ ID NO: 894) | 259 | |
| 49 | L_targ_Lnc_Lsh/Lw2/Ca/LbFSL_49 | (SEQ ID NO: 895) | 260 | |
| 1 | S_targ_GPCnc_Lsh/Lw2/Ca/LbFSL_1 | (SEQ ID NO: 896) | 261 | START OF GPCnc |
| 2 | S_targ_GPCnc_Lsh/Lw2/Ca/LbFSL_2 | (SEQ ID NO: 897) | 262 | |
| 3 | S_targ_GPCnc_Lsh/Lw2/Ca/LbFSL_3 | (SEQ ID NO: 898) | 263 | |
| 4 | S_targ_GPCnc_Lsh/Lw2/Ca/LbFSL_4 | (SEQ ID NO: 899) | 264 | |
| 5 | S_targ_GPCnc_Lsh/Lw2/Ca/LbFSL_5 | (SEQ ID NO: 900) | 265 | |
| 6 | S_targ_GPCnc_Lsh/Lw2/Ca/LbFSL_6 | (SEQ ID NO: 901) | 266 | |
| 7 | S_targ_GPCnc_Lsh/Lw2/Ca/LbFSL_7 | (SEQ ID NO: 902) | 267 | |
| 8 | S_targ_GPCnc_Lsh/Lw2/Ca/LbFSL_8 | (SEQ ID NO: 903) | 268 | |
| 9 | S_targ_GPCnc_Lsh/Lw2/Ca/LbFSL_9 | (SEQ ID NO: 904) | 269 | |
| 10 | S_targ_GPCnc_Lsh/Lw2/Ca/LbFSL_10 | (SEQ ID NO: 905) | 270 | |
| 11 | S_targ_GPCnc_Lsh/Lw2/Ca/LbFSL_11 | (SEQ ID NO: 906) | 271 | |
| 1 | S_targ_NPnc_Lsh/Lw2/Ca/LbFSL_1 | (SEQ ID NO: 907) | 272 | START OF NPnc |
| 2 | S_targ_NPnc_Lsh/Lw2/Ca/LbFSL_2 | (SEQ ID NO: 908) | 273 | |
| 3 | S_targ_NPnc_Lsh/Lw2/Ca/LbFSL_3 | (SEQ ID NO: 909) | 274 | |
| 4 | S_targ_NPnc_Lsh/Lw2/Ca/LbFSL_4 | (SEQ ID NO: 910) | 275 | |
| 5 | S_targ_NPnc_Lsh/Lw2/Ca/LbFSL_5 | (SEQ ID NO: 911) | 276 | |
| 6 | S_targ_NPnc_Lsh/Lw2/Ca/LbFSL_6 | (SEQ ID NO: 912) | 277 | |
| 7 | S_targ_NPnc_Lsh/Lw2/Ca/LbFSL_7 | (SEQ ID NO: 913) | 278 | |
| 8 | S_targ_NPnc_Lsh/Lw2/Ca/LbFSL_8 | (SEQ ID NO: 914) | 279 | |
| 9 | S_targ_NPnc_Lsh/Lw2/Ca/LbFSL_9 | (SEQ ID NO: 915) | 280 | |
| 10 | S_targ_NPnc_Lsh/Lw2/Ca/LbFSL_10 | (SEQ ID NO: 916) | 281 | |
| 11 | S_targ_NPnc_Lsh/Lw2/Ca/LbFSL_11 | (SEQ ID NO: 917) | 282 | |
| 12 | S_targ_NPnc_Lsh/Lw2/Ca/LbFSL_12 | (SEQ ID NO: 918) | 283 | |

Figure 71:
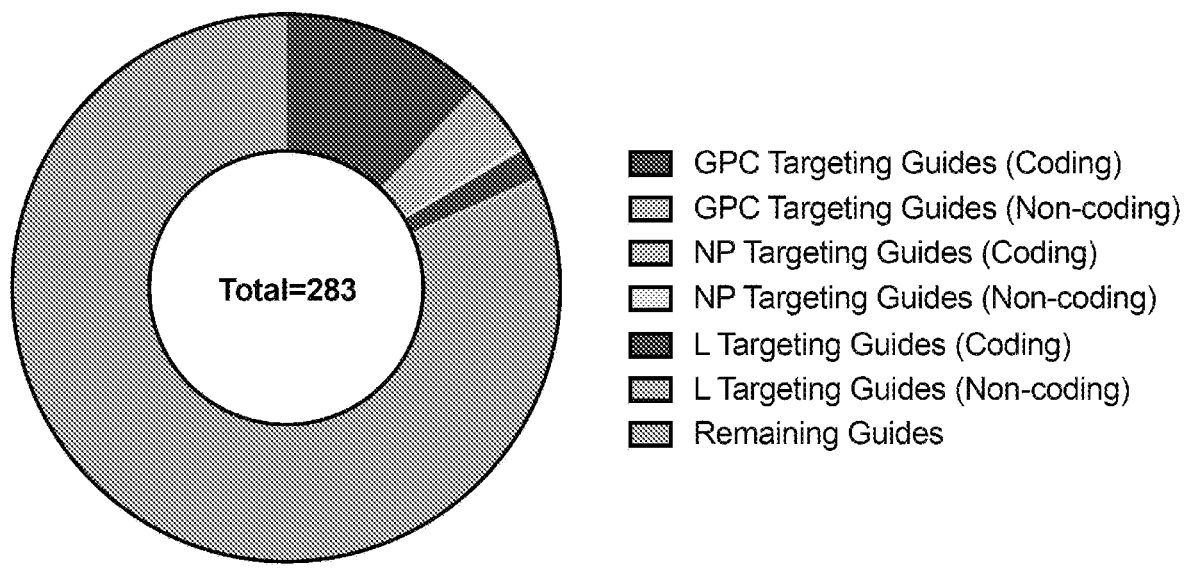
FIG. 71—Fraction of guides reducing viral replication. Mean GFP fluorescence 48 hours post LCMV infection was calculated from 3 replicates for all guides. Fold-change for each LCMV targeting guide was calculated as the ratio of the mean fluorescence of the control guide over the LCMV targeting guide. P values were calculated using a 2 tailed, unpaired t. test. Targeting guides were considered any guide with a p value less than or equal to 0.05 and fold change (FC) greater than or equal to 2. The pie chart plots the data displayed in the table with wedges corresponding to the non-coding and coding region of LCMV's 4 proteins. Remaining guides are those LCMV targeting guides that do not pass the p value and FC threshold.
Figure 72:
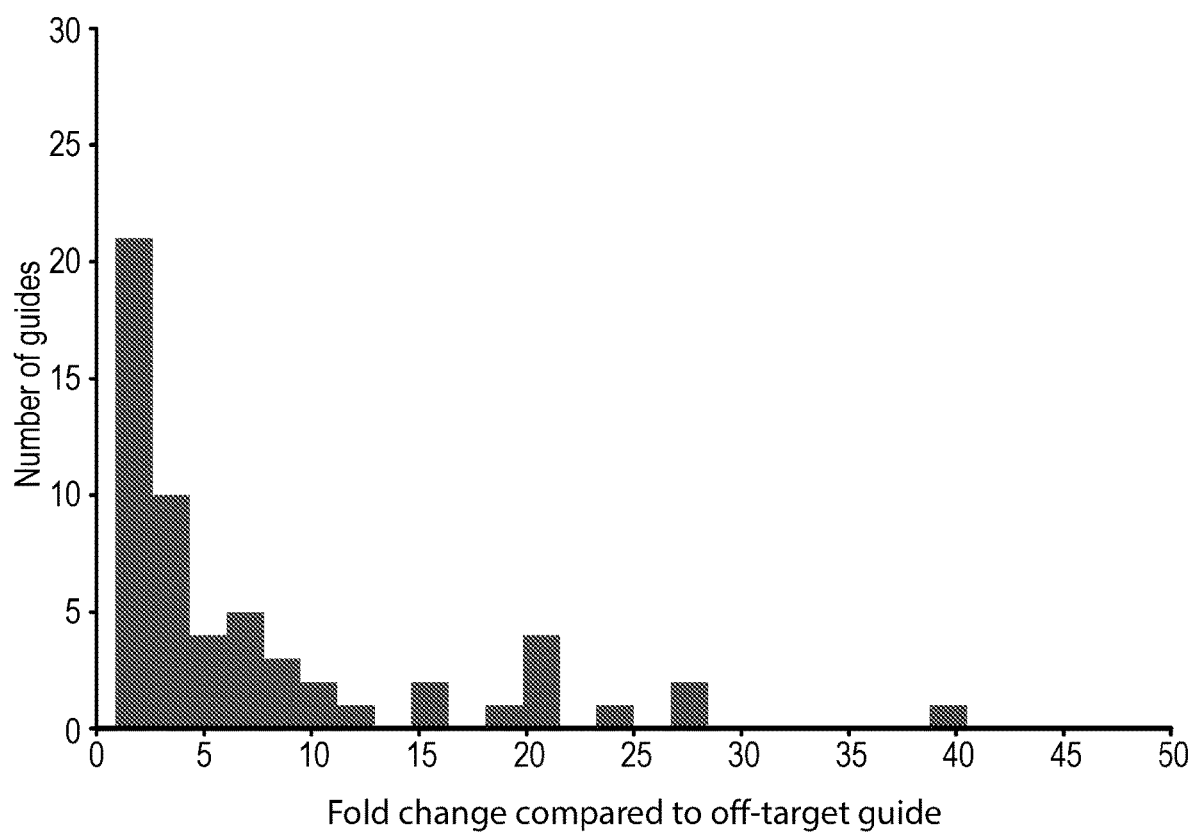
FIG. 72—Distribution of targeting efficiency of targeting guides. The distribution of fold change of GFP fluorescence (control guide over LCMV targeting guide) for guides that passed a p-value threshold of 0.05. Not shown on this graph, 8 guides with GFP fluorescence reduction greater than 50-fold (* 8 guides show reduction>50-fold).
Figure 74:
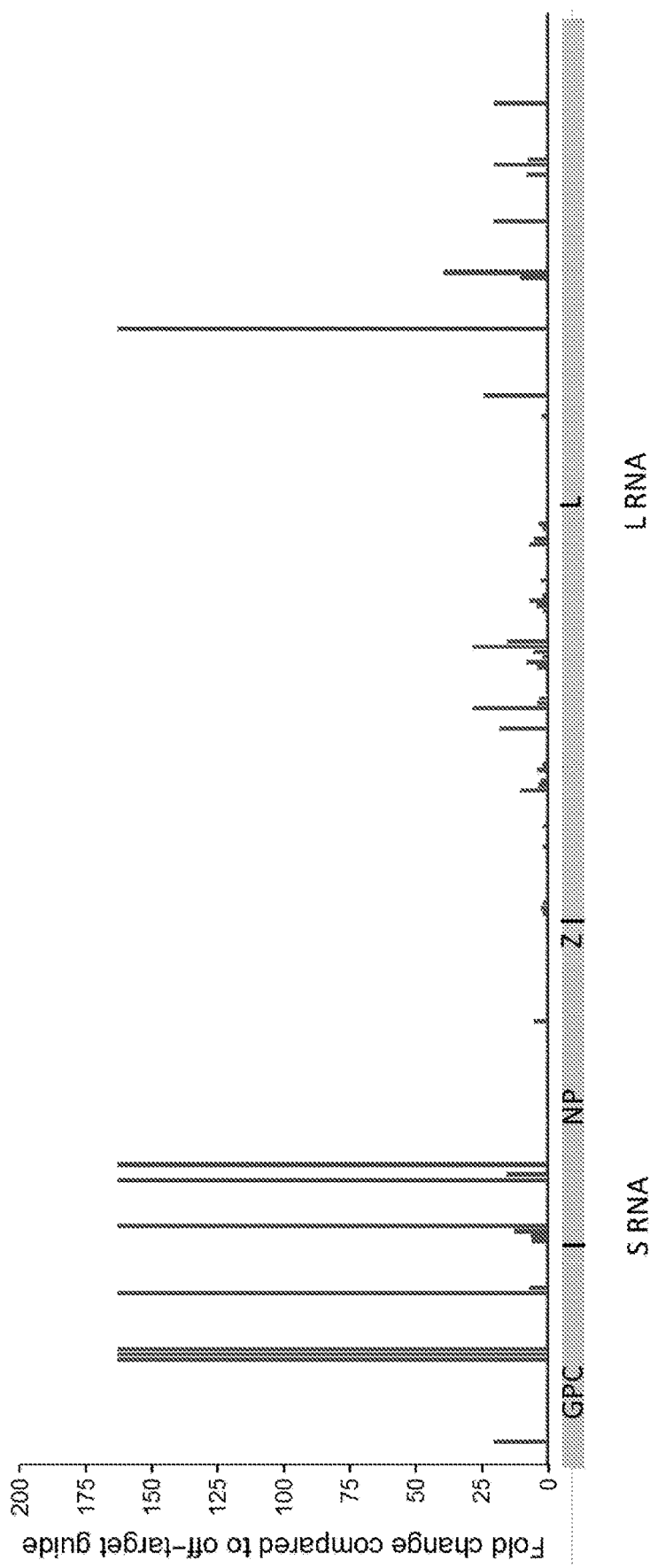
FIG. 74—Fold change of GFP fluorescence 48 hours post infection of control guide over LCMV-targeting guide for all guides that passed a p-value threshold of 0.05 and fold change threshold of 2. Each position on the x-axis is a guide that was tested in LCMV full-genome screen. Any guide that did not pass this threshold was plotted as 1. For any guide with fluorescence less than or at background, the fold change is set as the maximum fold change observed.
Figure 75:
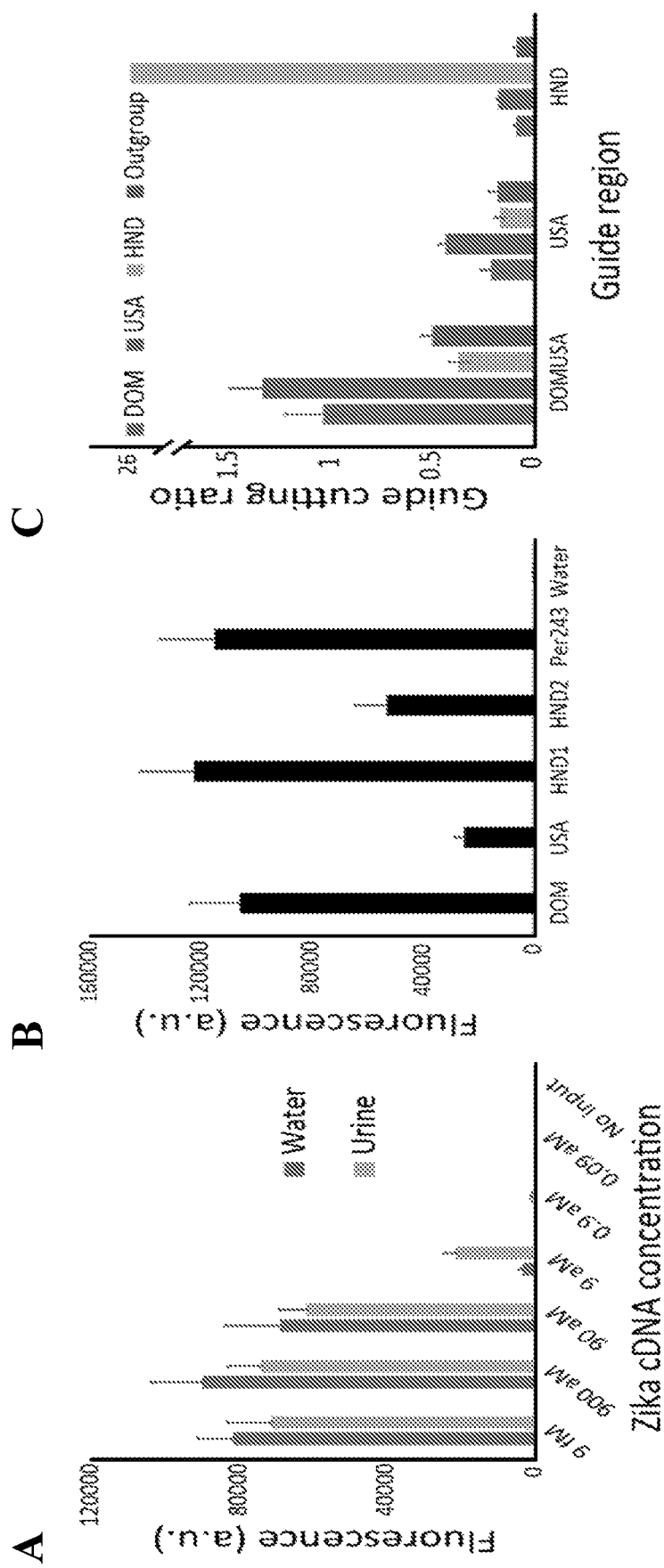
FIG. 75—Cas13a-based diagnostics can sensitively detect Zika virus nucleic acid. Zika virus cDNA was serially diluted in healthy human urine and water, inactivated endogenous human RNases, and used the SHERLOCK protocol to quantify viral cDNA (a). Several cDNA samples were also tested from patient urine or serum (b), and a combination of guide RNAs were used to distinguish between patient sample collected from different countries during the Zika virus outbreak (c). Error bars indicate one standard deviation. Abbreviations: DOM=Dominican Republic, DOMUSA=Dominican Republic/USA, HND=Honduras, USA=United States of America.
Figure 76:
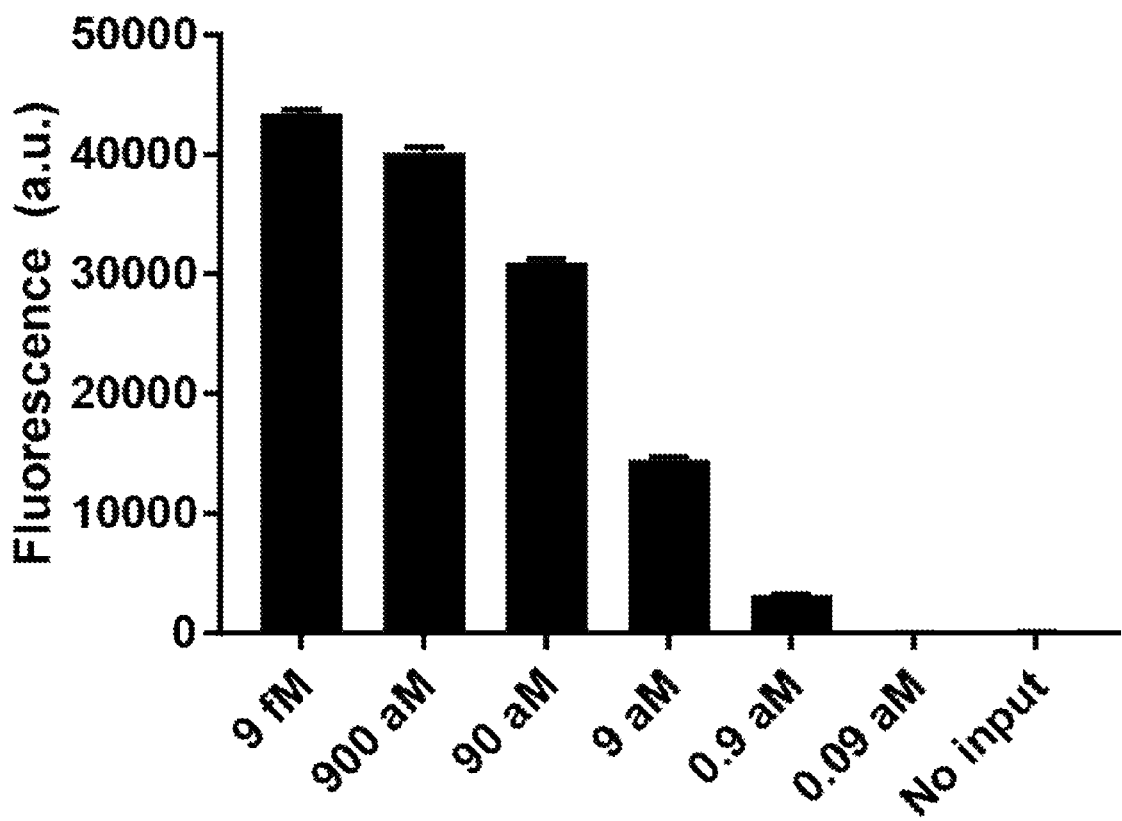
FIG. 76—provides a graph showing single copy detection of Zika in accordance with certain example embodiments.

To perform the screen, HTEK293FT cells were reverse transfected with a plasmid encoding Cas13a with BFP fluorescence and a plasmid encoding a single guide using lipofectamine 2000. Three control guides were also reverse transfected: 1 empty vector, and 2 off-target guides. Twenty-four hours after transfection, cells were infected with a GFP-expressing LCMV at an MOI 1 for 1 hour. Viral replication, as measured by GFP fluorescence, was then measured 48 hours post infection (72 hours post reverse transfection). The fraction of guides which reduce viral replication is provided in FIG. 71 and Table 22 below. The amount of viral reduction, as measured by fold change in GFP fluorescence, is provided in FIG. 72. FIG. 73 provides representative images illustrating the reduction of GFP. From FIG. 74 it is clear that targeting guides cluster along the LCMV genome.

TABLE 22

| Protein | Total guides tested | Total targeting guides | Targeting guides (in coding region) | Targeting guides (in non-coding region) |
|---|---|---|---|---|
| GPC | 43 | 6 | 5 | 1 |
| NP | 47 | 8 | 7 | 1 |
| Z | 11 | 0 | 0 | 0 |
| L | 182 | 39 | 34 | 5 |
| Totals | 283 | 53 | 46 | 7 |

TABLE 23

| T7promoter | (SEQ ID NO: 919) |
|---|---|
| ZikvBrazil_301-700 | (SEQ ID NO: 920) |
| ZikvBrazil_301-700_N139S | (SEQ ID NO: 921) |
| T7prom_ZikvBrazil_301-700 | (SEQ ID NO: 922) |
| T7prom_ZikvBrazil_301-700_N139S | (SEQ ID NO: 923) |

Figure 77:
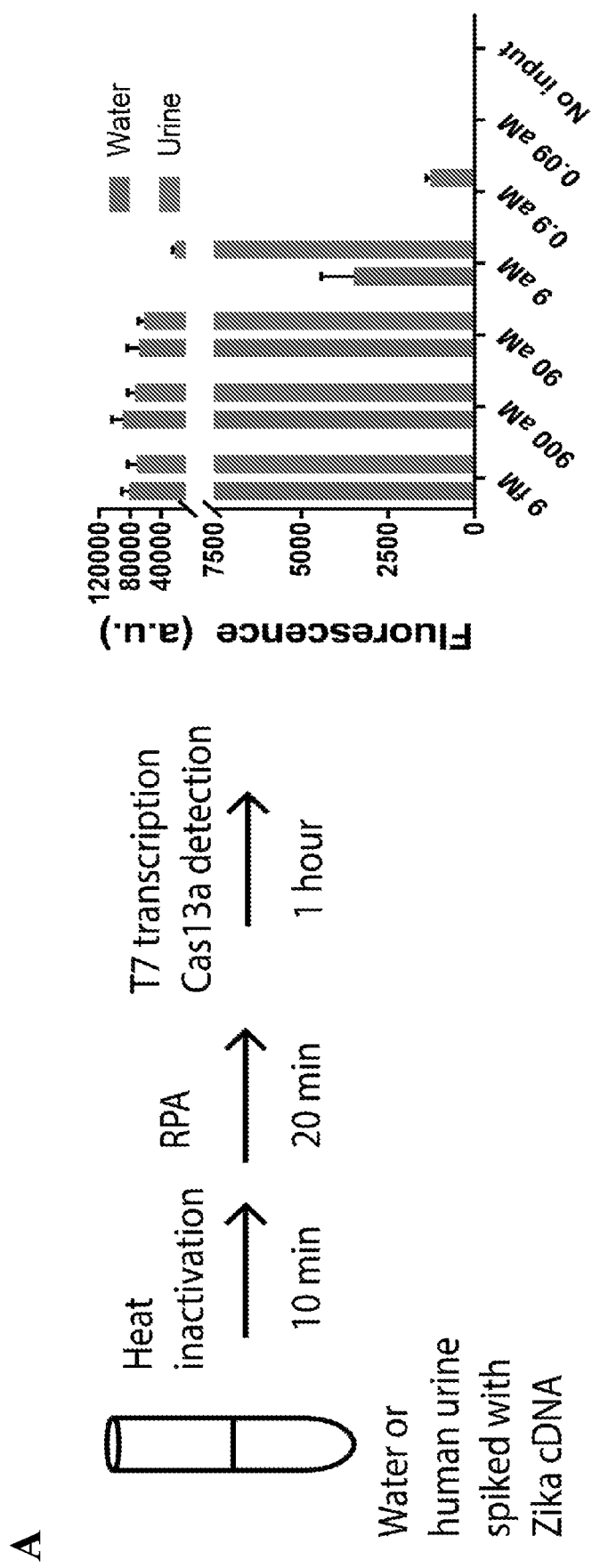
FIG. 77—illustrates the limits of detection of Zika cDNA (a), RNA (b), and virus particles (c) using the SHERLOCK method with Zika virus specific RPA primers and Zika virus specific crRNA. Error bars present 1 S.D. of 3 technical replicates. No input was the addition of nuclease-free water into either water or urine.
Figure 77:
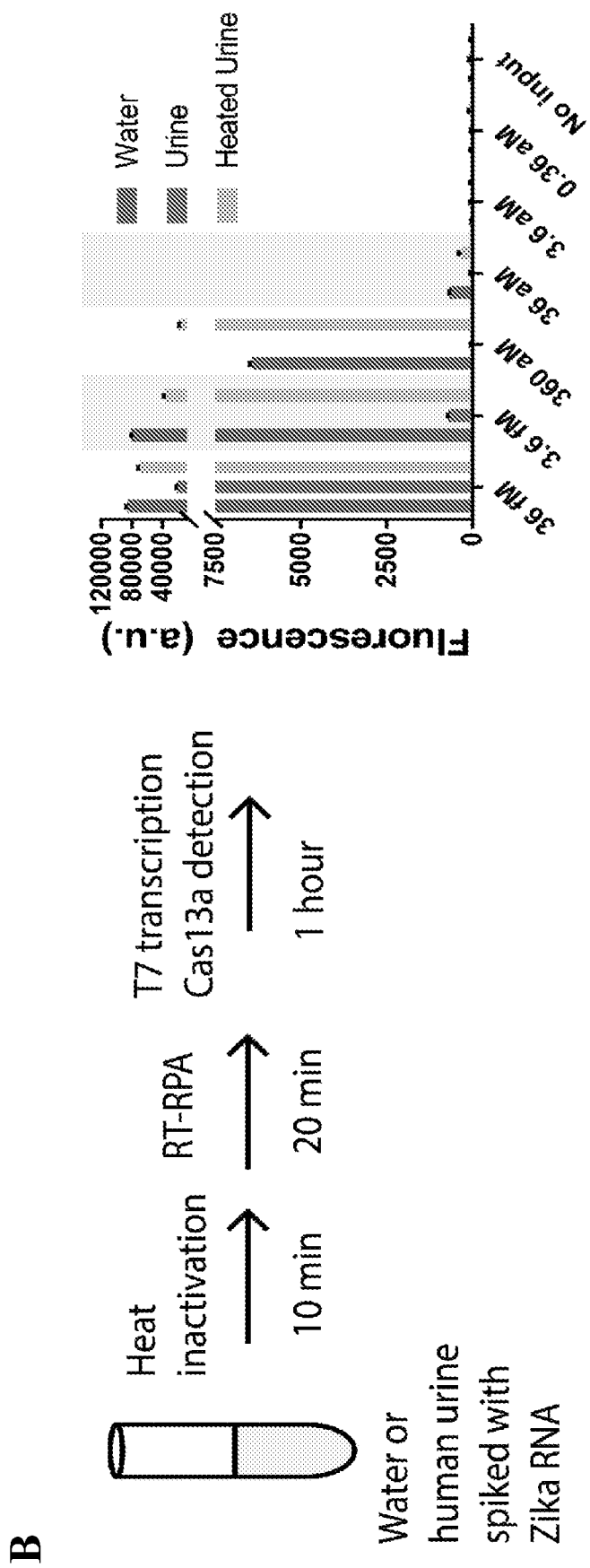
Figure 77:
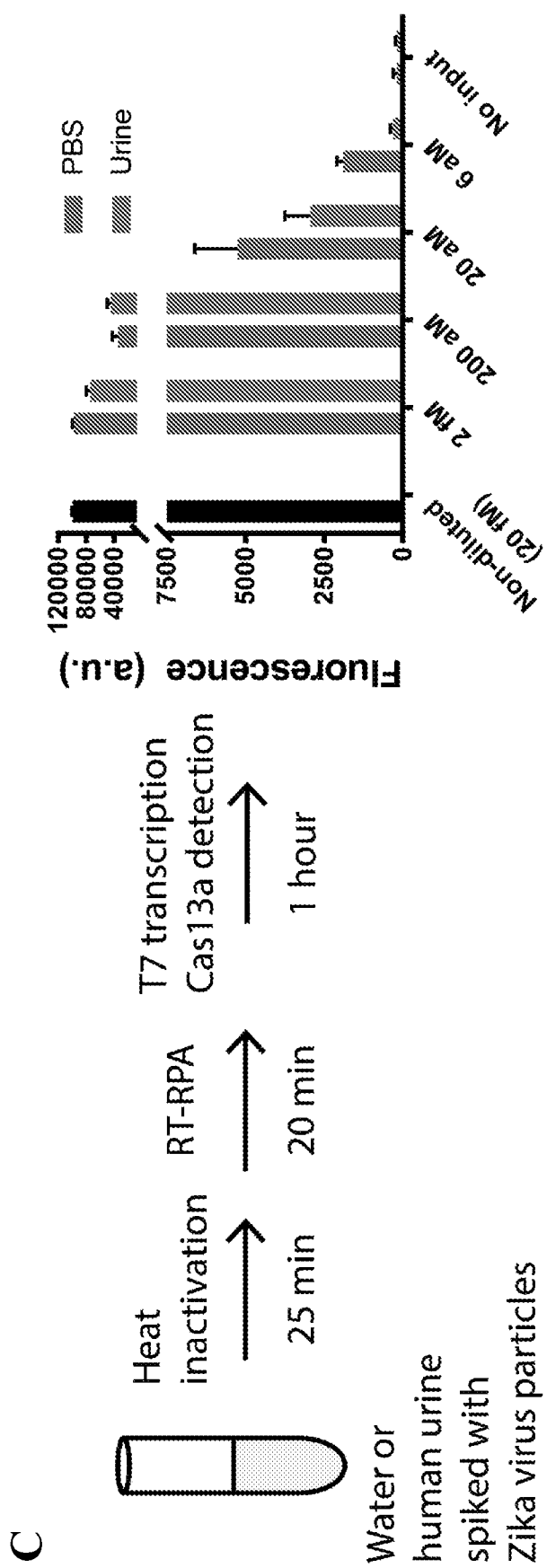

Example 5—Determination of Limit of Detection of Zika cDNA, RNA, and Virus Particles Limits of detection of Zika virus cDNA, RNA, and virus particles were determined using the SHERLOCK method with Zika virus specific RPA primers and Zika virus specific crRNA.

To detect cDNA, Zika virus cDNA derived from a viral seed stock was diluted into water or urine. Heat inactivation was performed to simulate the heat inactivation treatment of viral particles in a clinical sample as well as to inactivate the RNAses that are present in human urine. RPA was carried out for 20 minutes followed by Cas13a detection where fluorescence shown in the bar plot is that measured at 1 hour (FIG. 77A).

To detect RNA, Zika virus RNA derived from a viral seed stock was diluted into water, urine, or previously heat and RNAse inactivated urine. To heat and RNase inactivate healthy urine, TCEP/EDTA is added prior to heat treatment. This treatment shows the importance of RNase inactivation to prevent the degradation of RNA. RT-RPA was carried out for 20 minutes followed by Cas13a detection where fluorescence shown in the bar plot is that measured at 1 hour (FIG. 77B).

To detect virus particles, Zika virus particles from cell culture supernatant were diluted into PBS or urine. Samples were then heat and RNase inactivated with TCEP/EDTA and a 25-minute heat treatment (20 minutes at 55° C., 5 minutes of 95° C.). This two-step heat treatment allows for inactivation of the RNases in urine prior to the release of RNA from the viral particles (Zika virus particles are stable at temperatures below 65° C.). The 95° C. step releases the RNA from the viral particles post RNase inactivation. RT-RPA was carried out for 20 minutes followed by Cas13a detection where fluorescence shown in the bar plot is that measured at 1 hour (FIG. 77C).

Single nucleotide variants in viral samples were detected as follows. Samples were tested with both a crRNA that targets the mutant sequence and a crRNA that targets the wild-type sequence and the relative fluorescence was used to determine the allele present (FIG. 78A).

Figure 78:
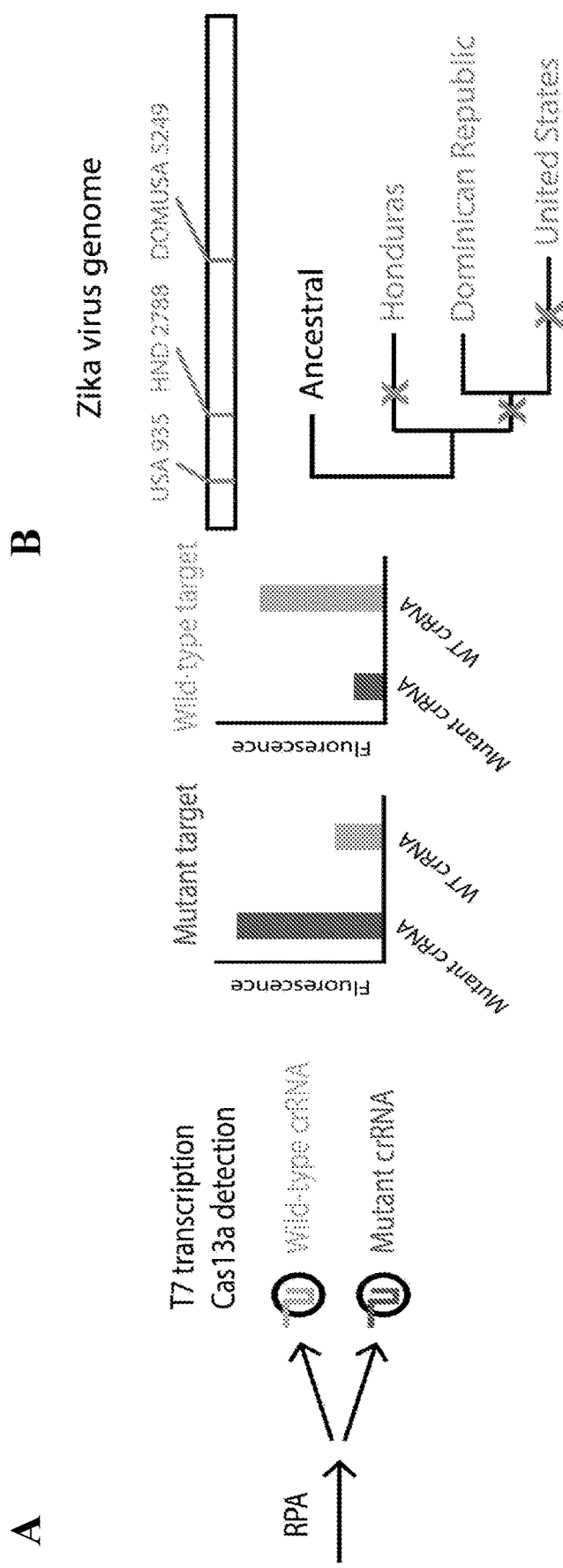
FIG. 78—panel A is a schematic of detecting single nucleotide variants in viral samples. Panel B is a schematic demonstrating the genome position of the 3 SNPs tested by the SHERLOCK method. Panel C shows graphs representing SNPs that arose during the 2015 Zika virus outbreak with the location where the SNP arose. Panel D represents the fluorescence ratio between the mutant cRNA over the wild-type cRNA at the 1-hour time point. Panel E shows a heatmap displaying the $\log_2$ transformed fluorescence ratios shown in FIG. 78D for each of the samples against each of the crRNAs. Values greater than 0 indicate the presence of the mutant variant. Panel F is a graph showing data with the S139N variant. The darkly shaded bars represent the fluorescence measured when the S139N targeting crRNA was used in the detection reaction and the lighter bars represent the fluorescence measured when the N139S targeting crRNA was used. Error bars represent 1 S.D. with 3 technical replicates.
Figure 78:
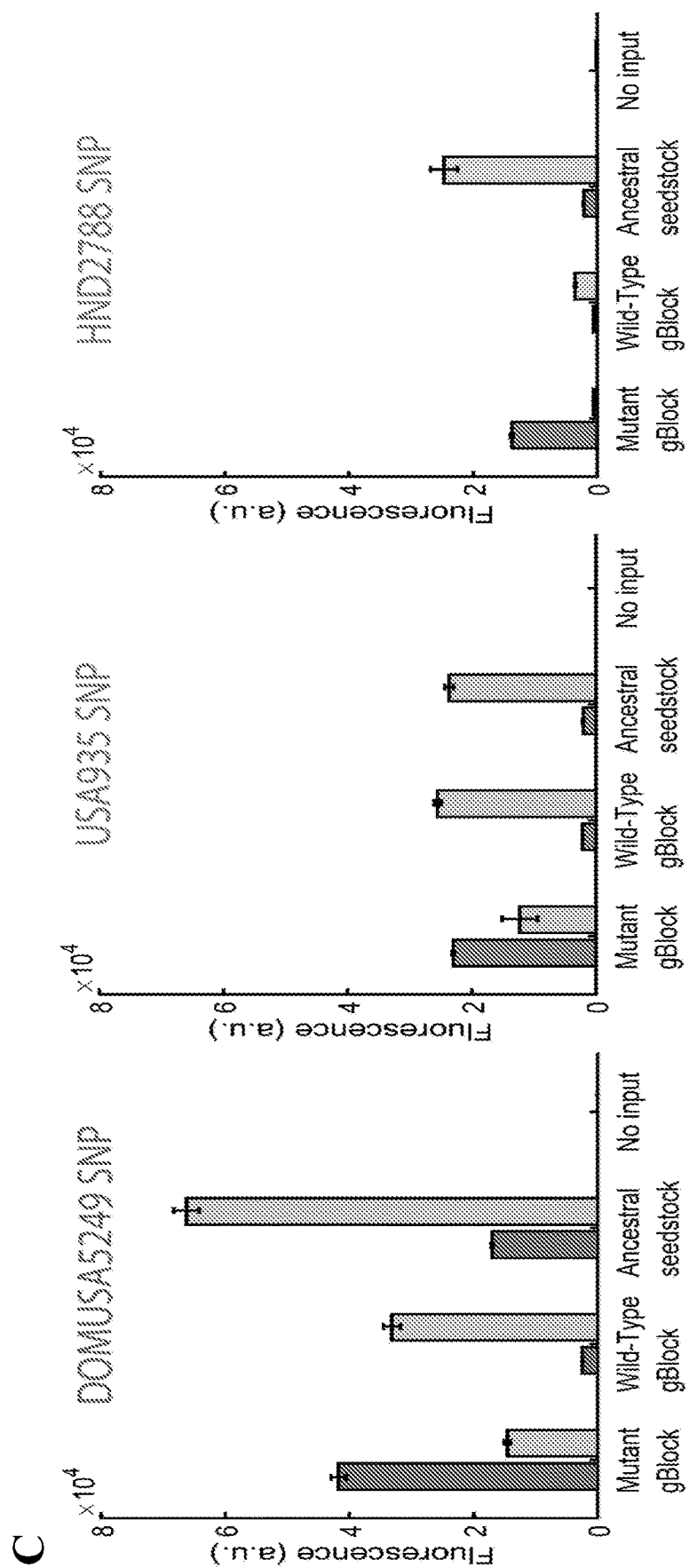
Figure 78:
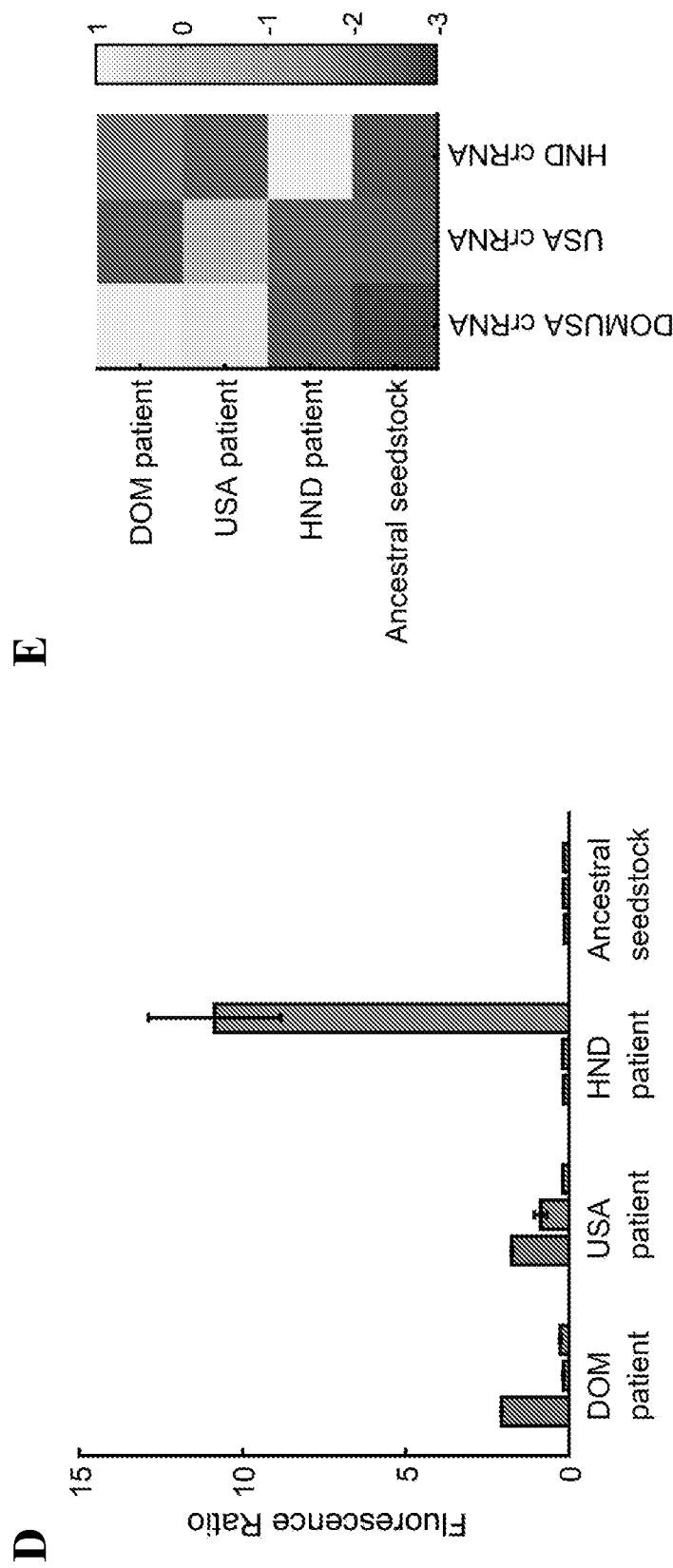
Figure 78:
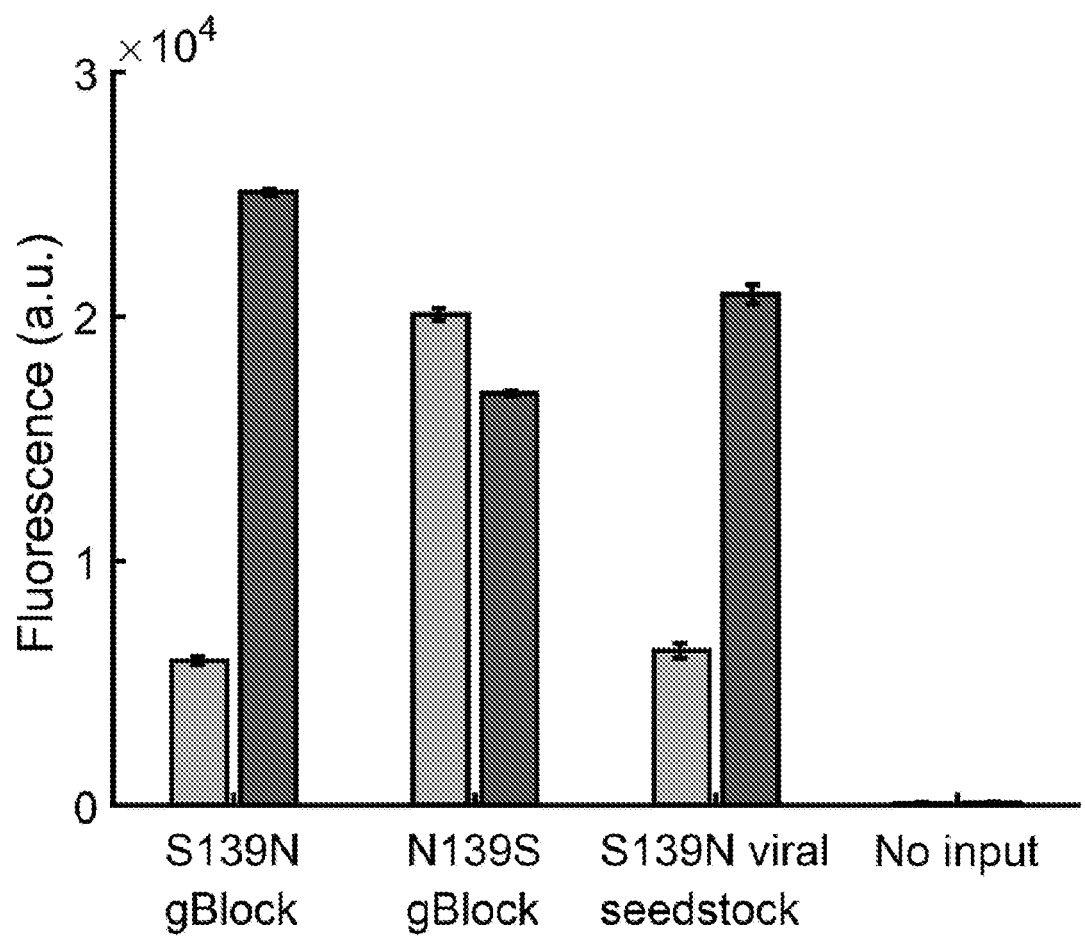

FIG. 78B demonstrates the genome position of the 3 SNPs tested by the SHERLOCK method. The simplified tree demonstrates the relationships between the SNPs and where the SNPs arose during the 2015 Zika virus outbreak.

FIG. 78C shows graphs corresponding to different SNPs that arose during the 2015 Zika virus outbreak with the location where the SNP arose. Each bar represents either a synthetic gBlock with the sequence that corresponds to either the mutant variant or wild-type variant, cDNA derived from a seed stock that possess the ancestral sequence (i.e., no mutant variants) or no input (water). Each sample was amplified by a 20-minute RPA and the bars represent the fluorescence at 1 hour of the detection reaction. The darker shaded bars represent the fluorescence measured when the mutant crRNA was used in the detection reaction and the lighter bars represent the fluorescence measured when the wild-type crRNA was used.

cDNA was derived from three clinical samples. One associate with each locale of the 2015 Zika outbreak, and cDNA derived from a seed stock with the ancestral sequence (no mutant variants) was tested with the mutant crRNA and wild-type crRNA. The graph shown in FIG. 78D represents the fluorescence ratio between the mutant cRNA over the wild-type cRNA at the 1 hour time point. A ratio greater than 1 indicates that the mutant crRNA had a greater fluorescence than that of the wild-type crRNA and thus indicates the presence of the mutant variant in the sample tested. Purple is the DOMUSA SNP, Orange the USA SNP, and green the HND SNP.

The heatmap in FIG. 78E displays the $\log_2$ transformed fluorescence ratios shown in FIG. 78D for each of the samples against each of the crRNAs. Values greater than 0 indicate the presence of the mutant variant.

S139N is the variant that was recently identified to play a role in the microcephaly phenotype observed during the recent Zika outbreak (Yuan, L. 2017. Science). Each bar in FIG. 78F represents either a synthetic gBlock with the sequence that corresponds to either the S139N variant or the N139S variant, cDNA derived from a seed stock that possess the S139N variant, or no input (water). Each sample was amplified by a 20-minute RPA and the bars represent the fluorescence at 1 hour of the detection reaction. The darkly shaded bars represent the fluorescence measured when the S139N targeting crRNA was used in the detection reaction and the lighter bars represent the fluorescence measured when the N139S targeting crRNA was used. We were able to design RPA primers and guides and test them within a week of the publication associating this variant with microcephaly—highlighting the speed/real-time nature of this method.

Example 6—SHERLOCK Panel for Dengue Virus

Figure 79:
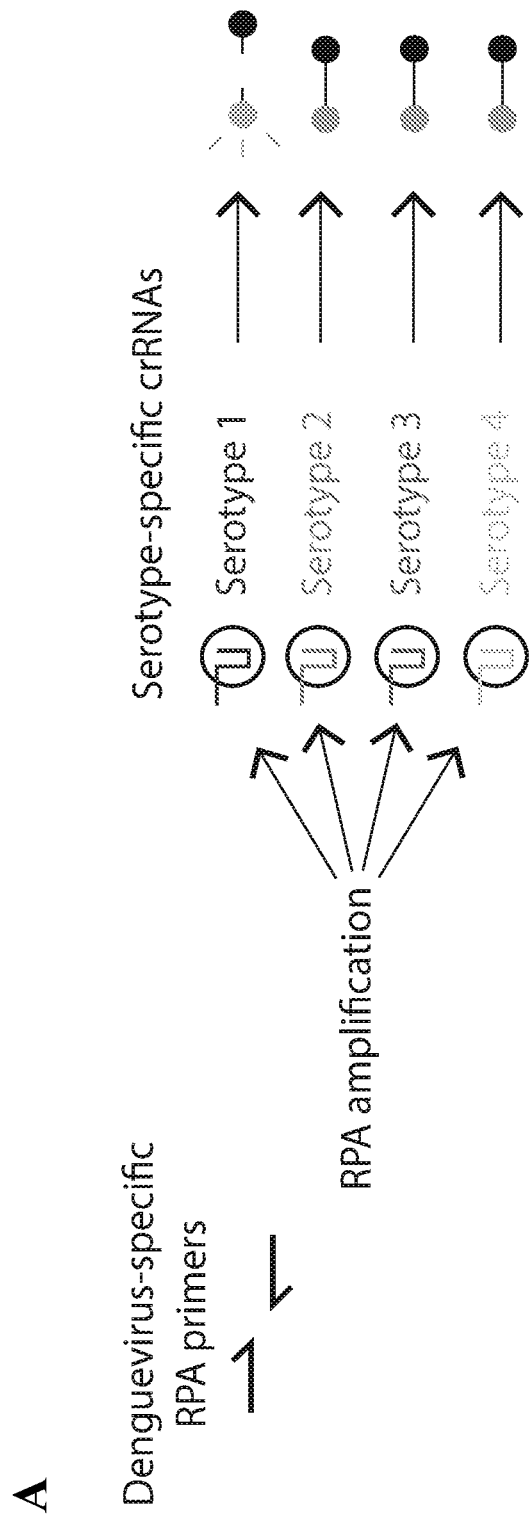
FIG. 79—panel A shows a schematic representing how the multi-serotype Dengue SHERLOCK panel works. In panel B, each tick on the x-axis represents the gblock template that was used as input for the SHERLOCK reaction. Each shade of purple designates a serotype specific crRNA. Error bars represent 1 S.D. with 3 technical replicates. Panel C shows an alternative representation of the bar plot in (b) as a log 10 scaled fluorescence.
Figure 79:
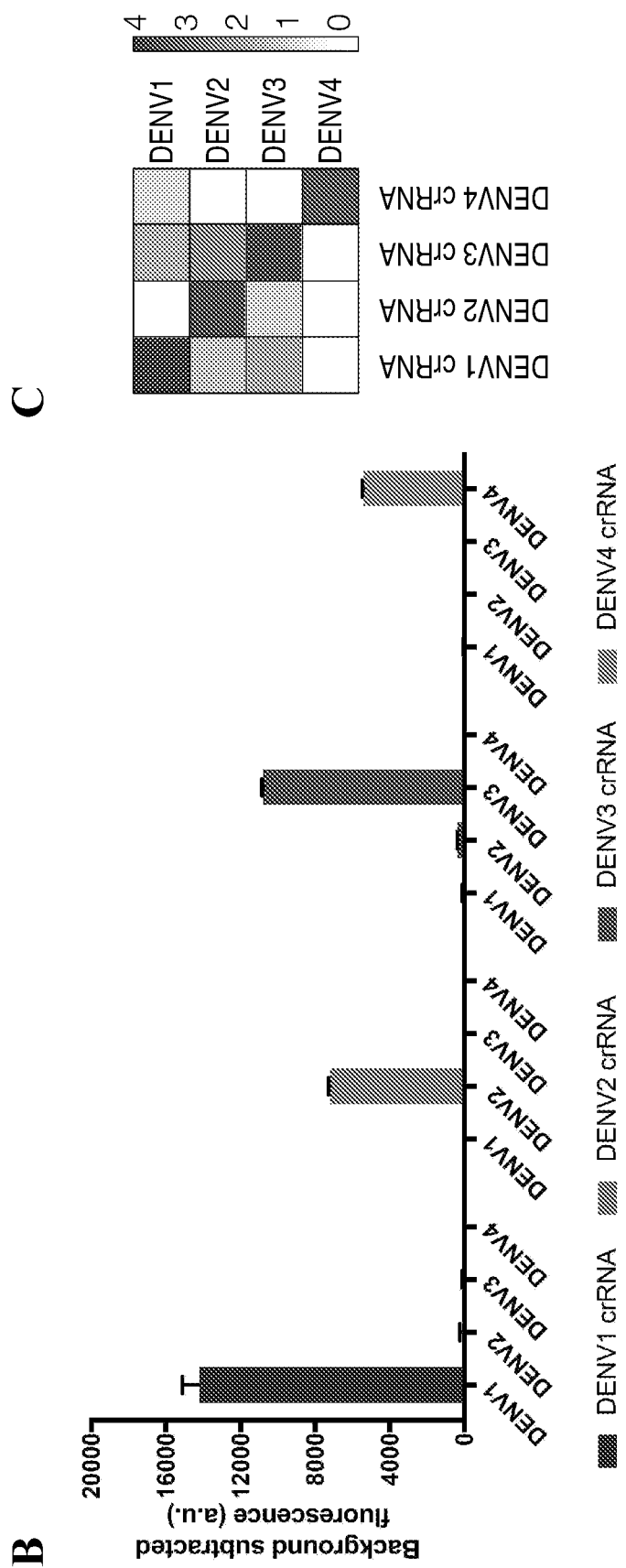

The multi-serotype Dengue SHERLOCK panel is illustrated in FIG. 79A. One set of RPA primers that are Dengue specific are used during the RPA. Then the RPA reaction is split into 4 reactions where a serotype specific guide is in each reaction to allow for distinguishing between the 4 serotypes of Dengue virus. In FIG. 79B, each tick on the x-axis represents the gblock template that was used as input for the SHERLOCK reaction. Each template was amplified with a single set of RPA primers and then each RPA reaction was tested against each of the crRNAs (DENV1 crRNA, DENV2 crRNA, DENV3 crRNA, and DENV4 crRNA). RPA reaction was carried out for 20 minutes, and the fluorescence shown in the bar plot is that measured at 3 hours. Each shade of purple designates a serotype specific crRNA. An alternative representation of this bar plot is shown in FIG. 79C as a log 10 scaled fluorescence.

Example 7—SHERLOCK Panel for Various Flaviruses

Figure 80:
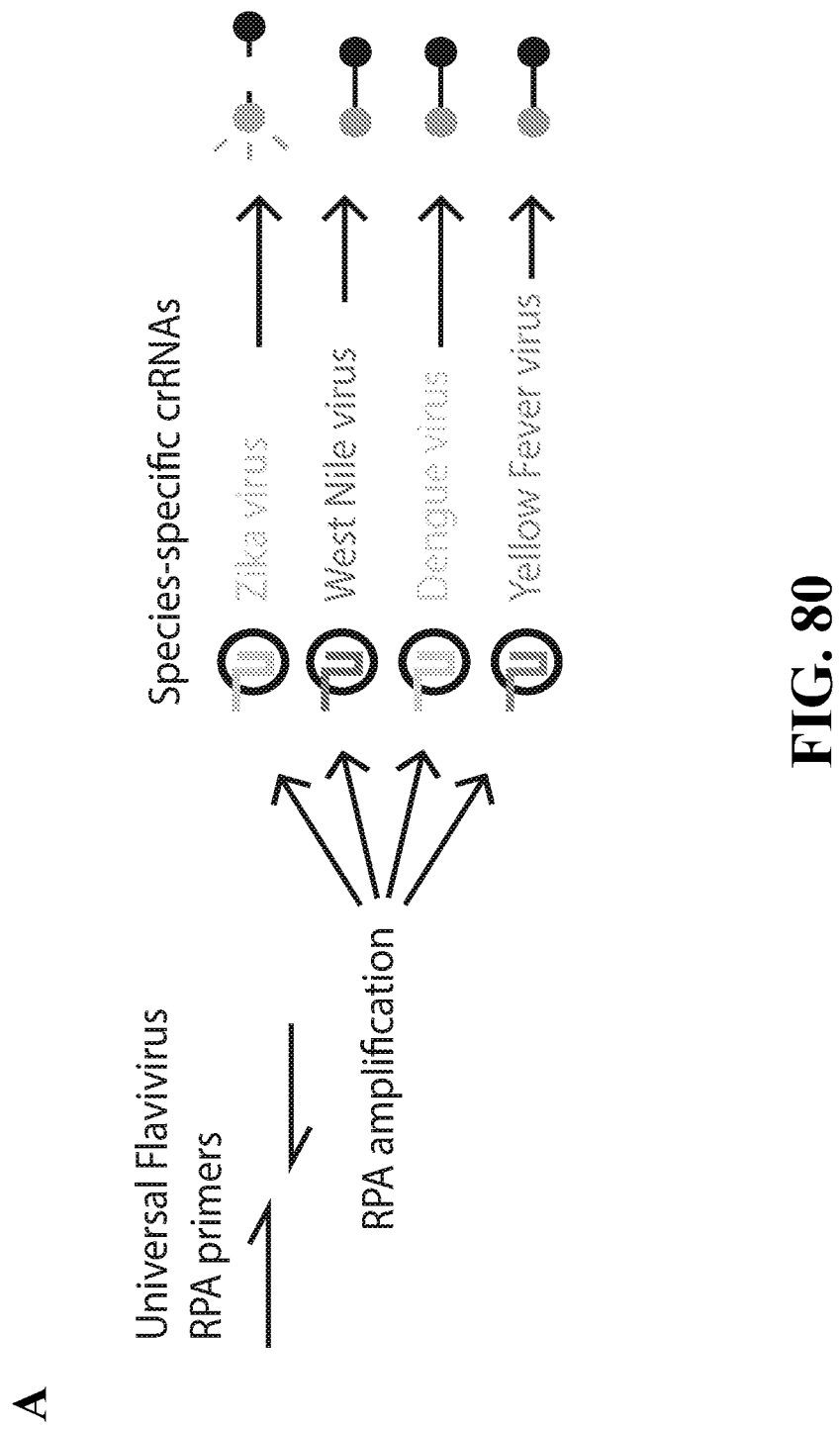
FIG. 80—a schematic representing how the Flavivirus SHERLOCK panel works is shown in panel A. In panel B, each tick on the x-axis represents the gblock template that was used as input for the SHERLOCK reaction. In panel C, each tick on the x-axis represents the two gblock templates that were used as input for the SHERLOCK reaction to simulate the ability of SHERLOCK to detect co-infections. Within each alternating white and grey block, each bar is the fluorescence resulting from the guide tested with the order of ZIKV crRNA, WNV crRNA, DENV crRNA, and YFV crRNA preserved in each block. In panels B and C, each color designates a virus-specific crRNA. Error bars represent 1 S.D. with 3 technical replicates.

FIG. 80A illustrates how the Flavivirus SHERLOCK panel works. One set of RPA primers that can amplify 4 different related flaviviruses are used in the RPA. Then the RPA reaction is split into 4 reactions where a virus specific guide is in each reaction to allow for distinguishing between the presence of Zika virus, West Nile virus, Dengue virus, and Yellow Fever virus. In FIG. 80B, each tick on the x-axis represents the gblock template that was used as input for the SHERLOCK reaction. Each template was amplified with a single set of RPA primers and then each RPA reaction was tested against each of the crRNAs (ZIKV crRNA, WNV crRNA, DENV crRNA, and YFV crRNA). RPA reaction was carried out for 20 minutes, and the fluorescence shown in the bar plot is that measured at 3 hours. Each color designates a virus-specific crRNA. In FIG. 80C, each tick on the x-axis represents the two gblock templates that were used as input for the SHERLOCK reaction to simulate the ability of SHERLOCK to detect co-infections. Each reaction was amplified with a single set of RPA primers and then each RPA reaction was tested against each of the crRNAs (ZIKV crRNA, WNV crRNA, DENV crRNA, and YFV crRNA). The RPA reaction was carried out for 20 minutes, and the fluorescence shown in the bar plot is that measured at 3 hours. Each color designates a virus-specific crRNA. Within each alternating white and grey block, each bar represents the fluorescence resulting from the guide tested with the order of ZIKV crRNA, WNV crRNA, DENV crRNA, and YFV crRNA preserved in each block. Alternative representations of the measured fluorescence represented in the bar plots in FIGS. 80B and 80C are shown in FIGS. 81A and 81B, respectively.

Example 8—Viral Diagnosis with CRISPR-Cas13a

Applicants use the CRISPR-Cas13 detection platform SHERLOCK to directly detect Zika virus from urine, distinguish multiple pathogenic viruses, and identify clinically relevant adaptive mutations.

Recent viral outbreaks have highlighted the great challenges of diagnosing viral infections, especially in remote areas far from clinical laboratories. Viral diagnosis was especially difficult during the 2016 ZIKV outbreak, in part because ZIKV maintains low titers in human specimens and is a transient infection. As a result of limitations with existing diagnostic technologies, the virus circulated for months before the first cases were confirmed clinically (Metsky et al. 2017). For example, nucleic acid detection is very sensitive and rapidly adaptable, but requires extensive sample manipulation and expensive machinery. In contrast, antigen- and antibody-based tests are faster and require minimal equipment but have reduced sensitivity and specificity and can take months to develop. An ideal diagnostic would combine the sensitivity, specificity, and flexibility of nucleic acid diagnostics with the low cost and speed of antigen-based tests. Such a diagnostic could be rapidly developed and deployed in the face of emerging viral outbreaks and would be suitable for disease surveillance in the field.

Here, Applicants develop viral diagnostics using the Cas13-based nucleic acid detection platform SHERLOCK (Specific High Sensitivity Enzymatic Reporter UnLOCKing) (FIG. 82A). Cas13, an RNA-guided ribonuclease, can amplify signals>1,000-fold via collateral cleavage, and provides enhanced specificity based on crRNA:target pairing. Cas13 also allows for a highly adaptable viral diagnostic platform as new viral pathogens or mutations can be targeted by merely changing the crRNA sequence. Pairing Cas13a with an upstream isothermal amplification using Recombinase Polymerase Amplification (RPA) further increases its sensitivity without the requirement of expensive machinery. Using this SHERLOCK platform, Applicants detect viruses directly from bodily fluids, create virus panels to distinguish multiple viral species and strains, and develop diagnostics to identify clinically relevant mutations.

Figure 86:
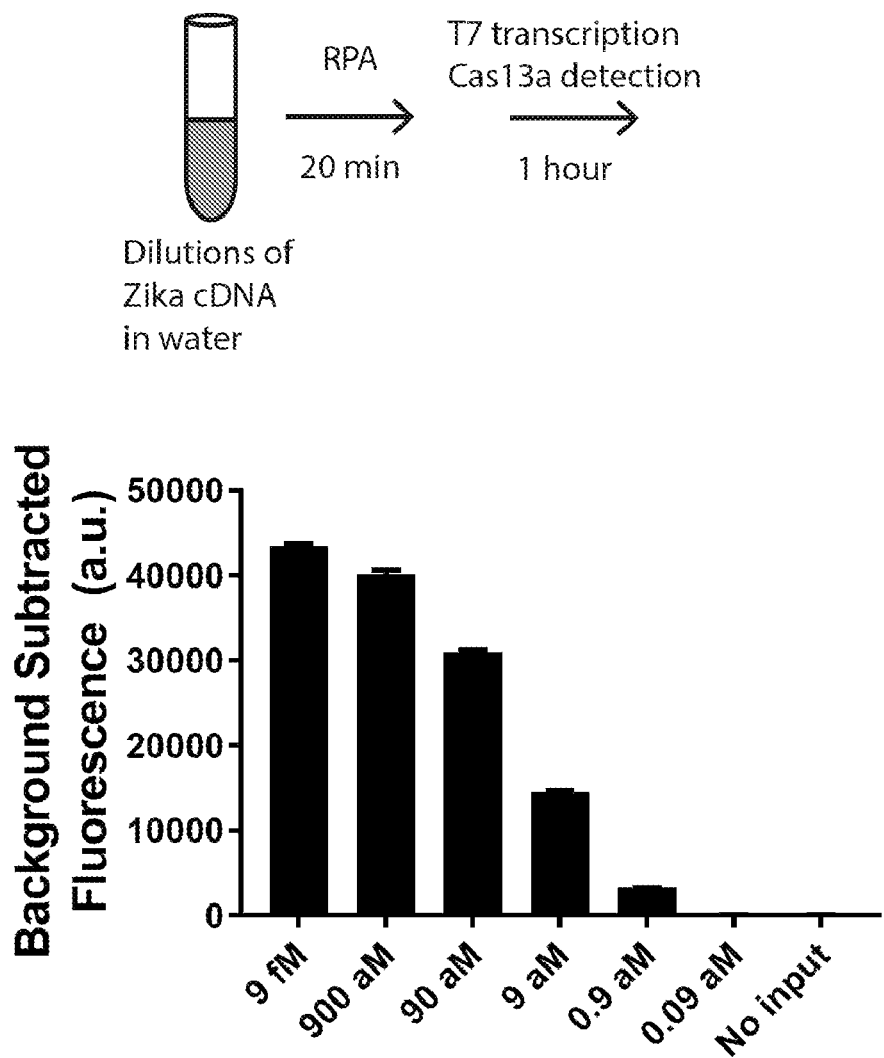
FIG. 86—SHERLOCK can detect ZIKV cDNA with high sensitivity. Applicants show SHERLOCK fluorescence values after 20 minutes of RPA and 1 hour of detection for serial dilutions of ZIKV cDNA. Error bars indicate 1 S.D. based on 3 technical replicates. In this experiment, RNase Alert v1 (IDT) was used as the RNA reporter.

Applicants first examined the sensitivity of a SHERLOCK assay for ZIKV (Gootenberg et al. 2017) and determined that it had single-copy (1 cp) sensitivity for ZIKV cDNA (FIG. 86). Applicants evaluated the performance of SHERLOCK on a set of 40 cDNAs derived from samples from the 2016 ZIKV outbreak (FIG. 82B, FIG. 87). This included 37 samples from patients with ZIKV (13 plasma samples, 13 serum samples, and 11 urine samples) and 3 samples from mosquito pools. Applicants were able to detect ZIKV in cDNA from 25 of 37 clinical samples (68%), and 3 of 3 mosquito pools (100%). Applicants compared SHERLOCK detection for these 40 cDNA samples to a much more involved amplicon PCR method where the entire ZIKV cDNA is tiled and amplified using two different PCR primer pools containing 35 target sites (Quick et al. 2017) (FIG. 82C). Applicants quantified these amplicon PCR products using an Agilent Tapestation and selected a threshold for determining the presence or absence of ZIKV (red dashed line) to maximize accuracy as measured by genome sequence coverage (FIG. 88, see Methods for details). Of the 32 samples that were positive using at least one method, 25 were positive by both methods, for 78% concordance (see Venn diagram). Both methods had equal performance, despite tiling the whole genome by amplicon PCR, and also using a larger input volume for amplicon PCR (2.5 µl) than for SHERLOCK (1 µl). These results demonstrate the sensitivity of SHERLOCK and its successful application to clinical samples.

Figure 89:
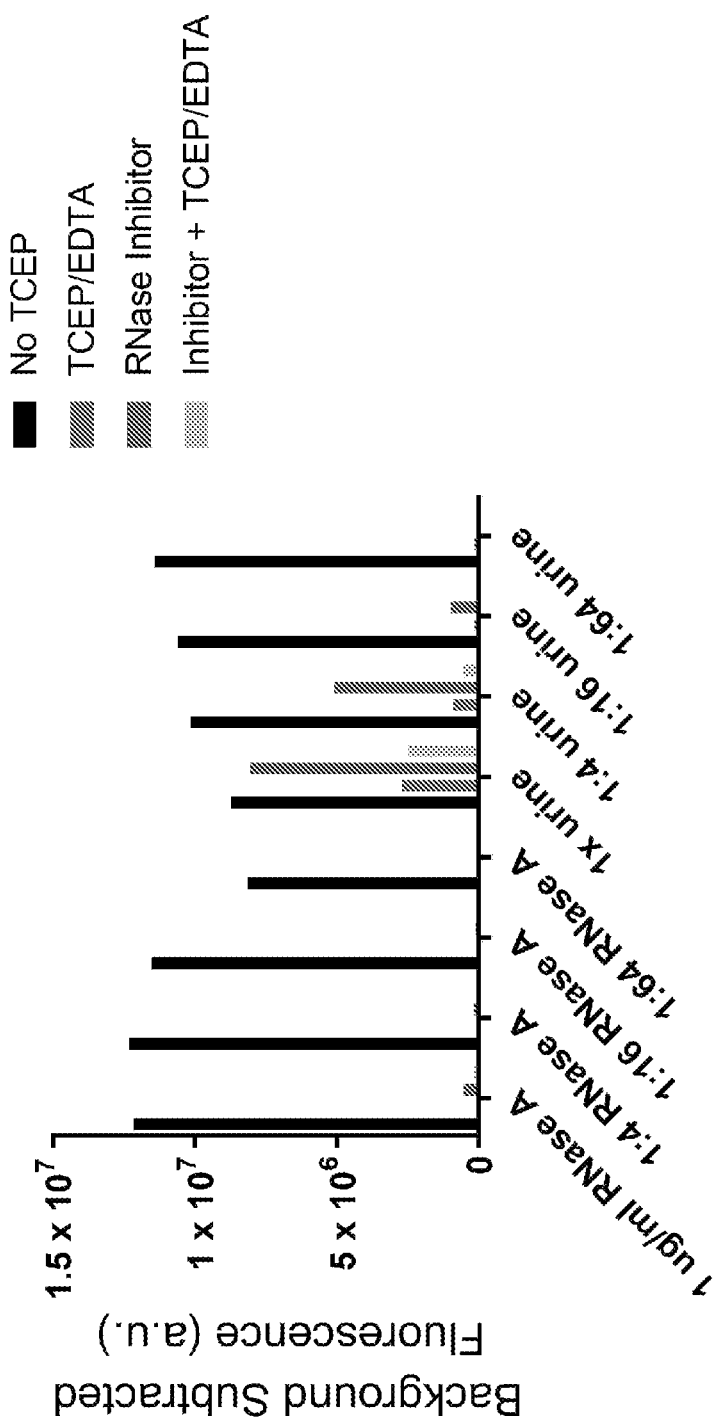
FIG. 89—RNase inactivation using heat and chemical treatment. Serial 1:4 dilutions of RNase A (1 μg/ml) or healthy human urine were treated with TCEP and EDTA at final concentrations of 100 mM and 1 mM respectively. Samples were incubated at 95° C. for 10 minutes, then RNase Alert v1 (IDT) was added to each sample, and fluorescence was monitored to determine nuclease activity. Fluorescence values are shown after 1 hour of incubation at 37° C. Error bars indicate 1 S.D. based on 3 technical replicates.
Figure 90A:
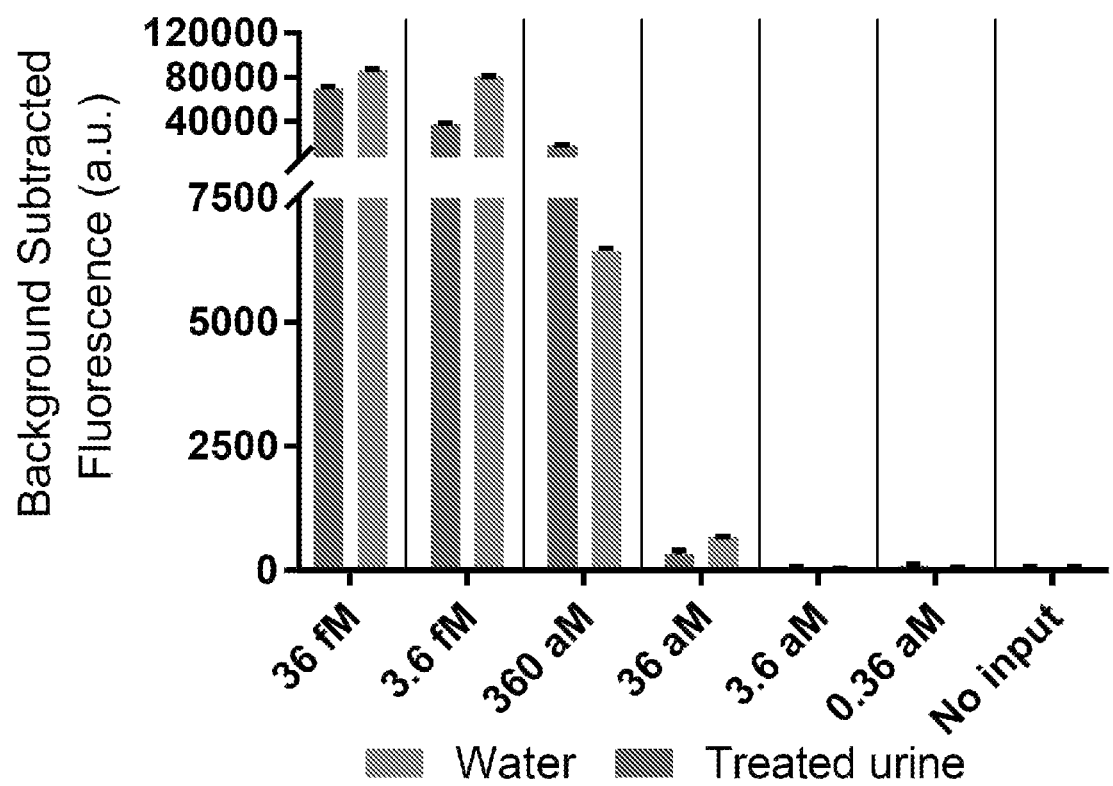
FIG. 90—(A) Pretreatment of urine allows for sensitive RNA detection with SHERLOCK. Applicants show fluorescence data after 1 hour of detection for RNA diluted in water (blue), and RNA diluted in urine pre-treated at 95° C. for 10 minutes with 100 mM TCEP and 1 mM EDTA (light red). (B) Carrier RNA does not improve SHERLOCK sensitivity. Applicants diluted ZIKV RNA in partially inactivated healthy human urine in the presence or absence of 100 ng of carrier RNA (see Methods section for details). As in (A), 1 hour of detection was used. Error bars indicate 1 S.D. based on 3 technical replicates.
Figure 90B:
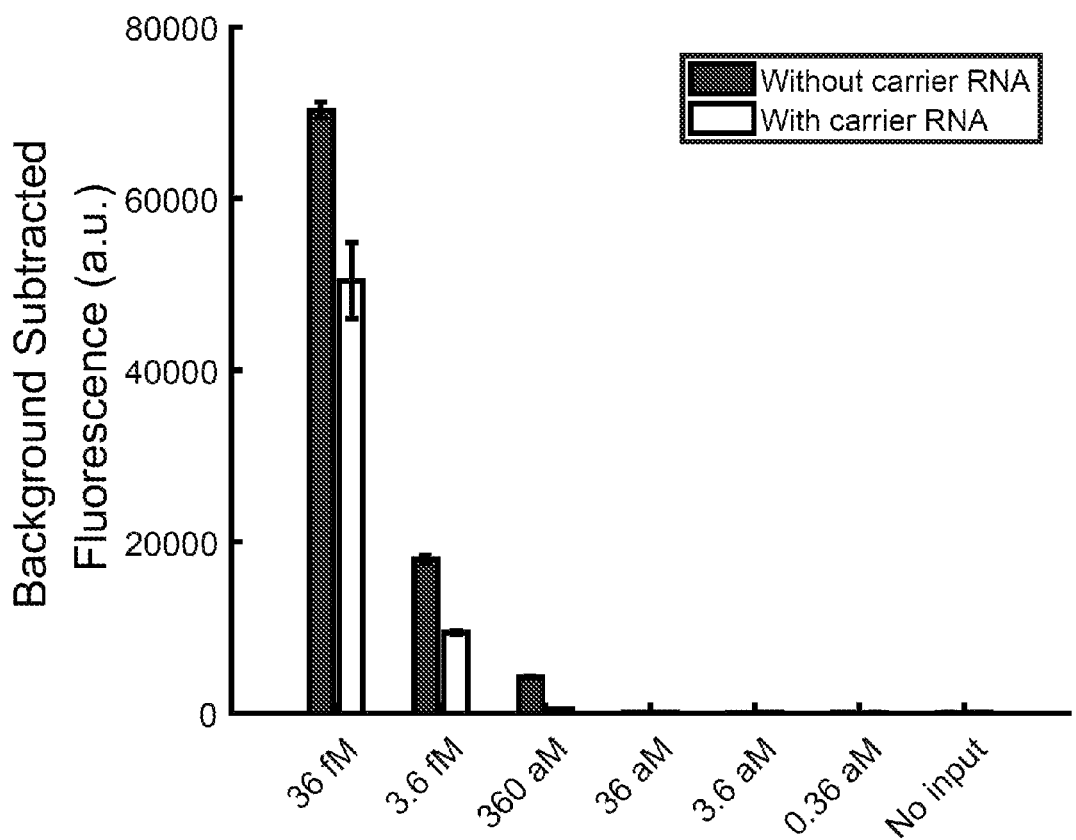
Figure 91:
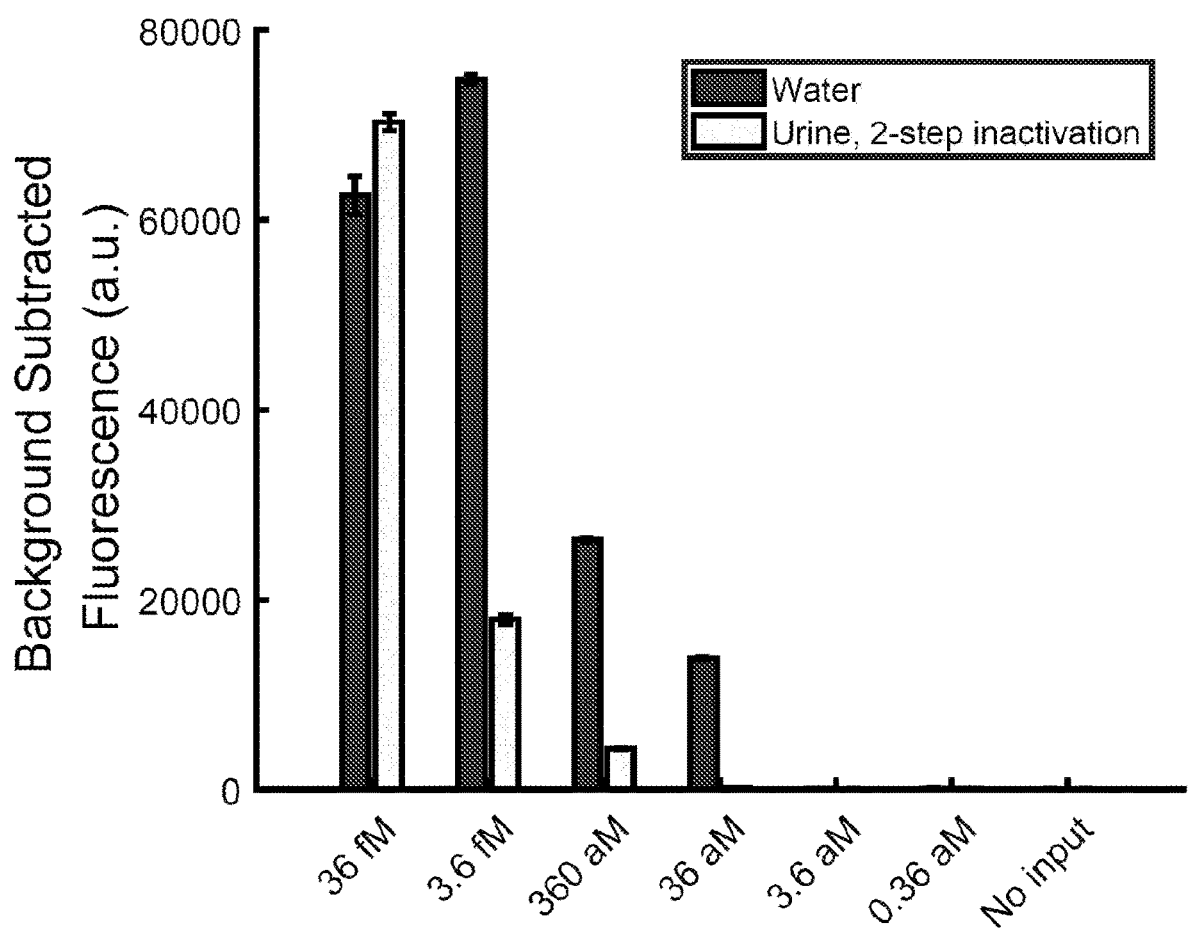
FIG. 91—RNase inactivation at a lower temperature. Applicants tested a two-step heat inactivation protocol in which healthy human urine was incubated at 50° C. for 20 minutes, followed by 95° C. for 5 minutes. RNA was diluted in urine after the 50° C. step but before the 95° C. step. Error bars indicate 1 S.D. based on 3 technical replicates.

Nucleic acid extraction is time-consuming, requires expert knowledge, and often is not feasible in the field. Applicants thus developed a SHERLOCK protocol that can amplify and detect nucleic acid from urine without extraction. Applicants used a combination of heat and chemical reduction to lyse viral particles and inactivate RNases (FIG. 89), which are present in urine at ≅1 µg/ml (Weickmann and Glitz 1982). Applicants directly used this treated urine as an input to RPA without dilution. This approach enabled single-copy detection of ZIKV cDNA diluted in urine (FIG. 83A). If ZIKV RNA was diluted in non-treated urine, the sensitivity was reduced to 3.6 fM (1,800 cp/µl), presumably due to RNase degradation (FIG. 83B). Diluting ZIKV RNA in treated urine allowed for equally sensitive detection compared with water (36 aM or 18 cp/µl, FIG. 90). Naturally, ZIKV RNA is encapsulated in viral particles, which protect the RNA from degradation. Applicants developed a 2-step heat inactivation protocol in which samples are first heated below the melting temperature of ZIKV particles to inactivate RNases, then at 95° C. for 5 minutes to lyse and inactivate viral particles (FIG. 91) (Müller et al. 2016). This enabled sensitive detection of ZIKV from infectious particles at 20 aM (10 cp/µl) in <2 h (FIG. 83C). To reach a sensitivity of 6 aM (3 cp/µl) in urine, Applicants used a 3-hour detection step, for a total turnaround time<4 hours (FIG. 83C inset).

Figure 84C:
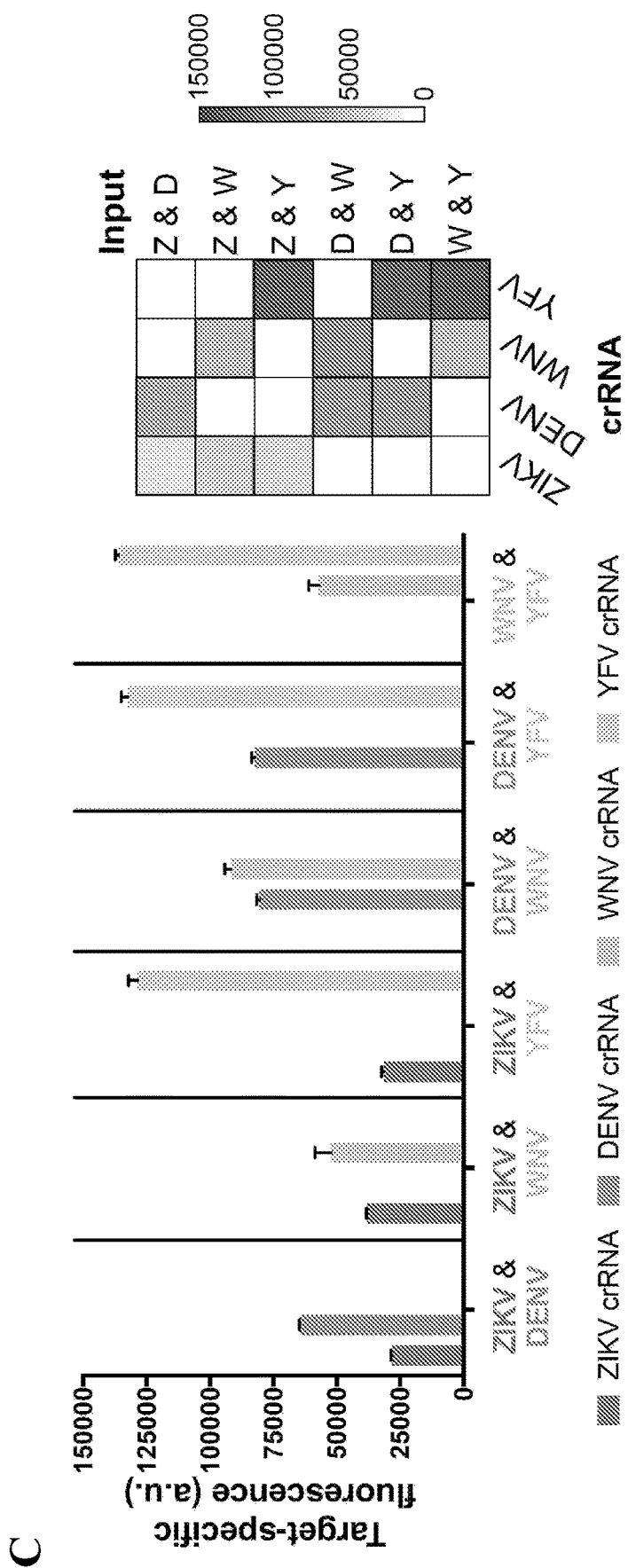
FIG. 84—SHERLOCK panels can differentiate viral species and serotypes. (A) Detection of 4 related Flaviviruses using SHERLOCK. (B) Target-specific fluorescence at 3 hours is shown for each crRNA against each virus in both the bar plot and heatmap. (C) Target-specific fluorescence at 3 hours is shown when two viral targets are present in a single sample. (D) Detection of DENV serotypes 1-4 using SHERLOCK. (E) Target-specific fluorescence at 3 hours is shown for serotype-specific crRNAs against each of the DENV serotypes. Target-specific fluorescence is fluorescence for each target against a crRNA relative to the fluorescence of the crRNA with no input. In all panels, error bars indicate 1 S.D. based on 3 technical replicates.
Figure 92:
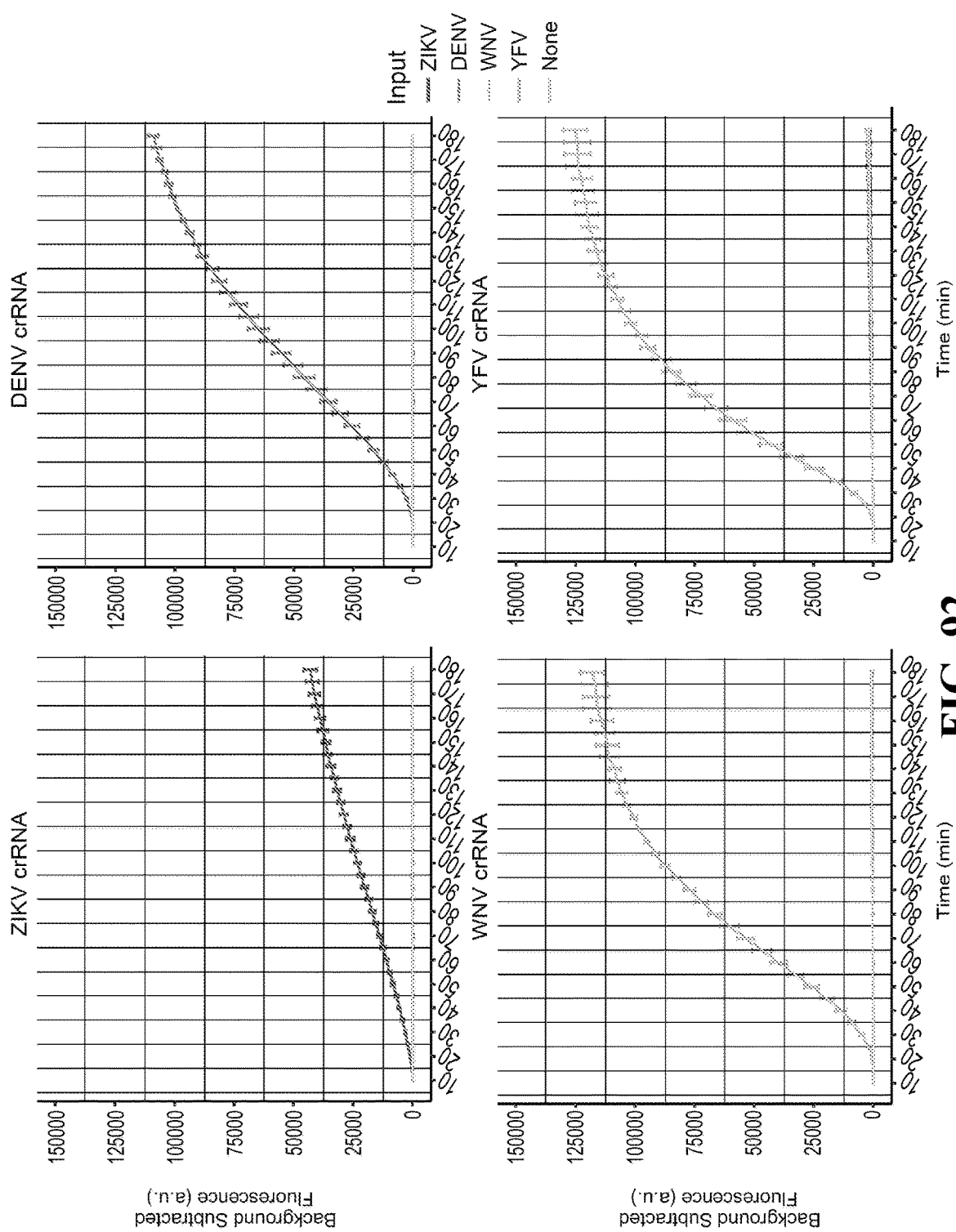
FIG. 92—Flavivirus panel time course. Each panel shows the background-corrected fluorescence of a viral-specific crRNA against each flavivirus target and the no input control over a 3-hour time course with fluorescence measurements every 5 minutes. Error bars are 1 S.D. based on 3 technical replicates.
Figure 93:
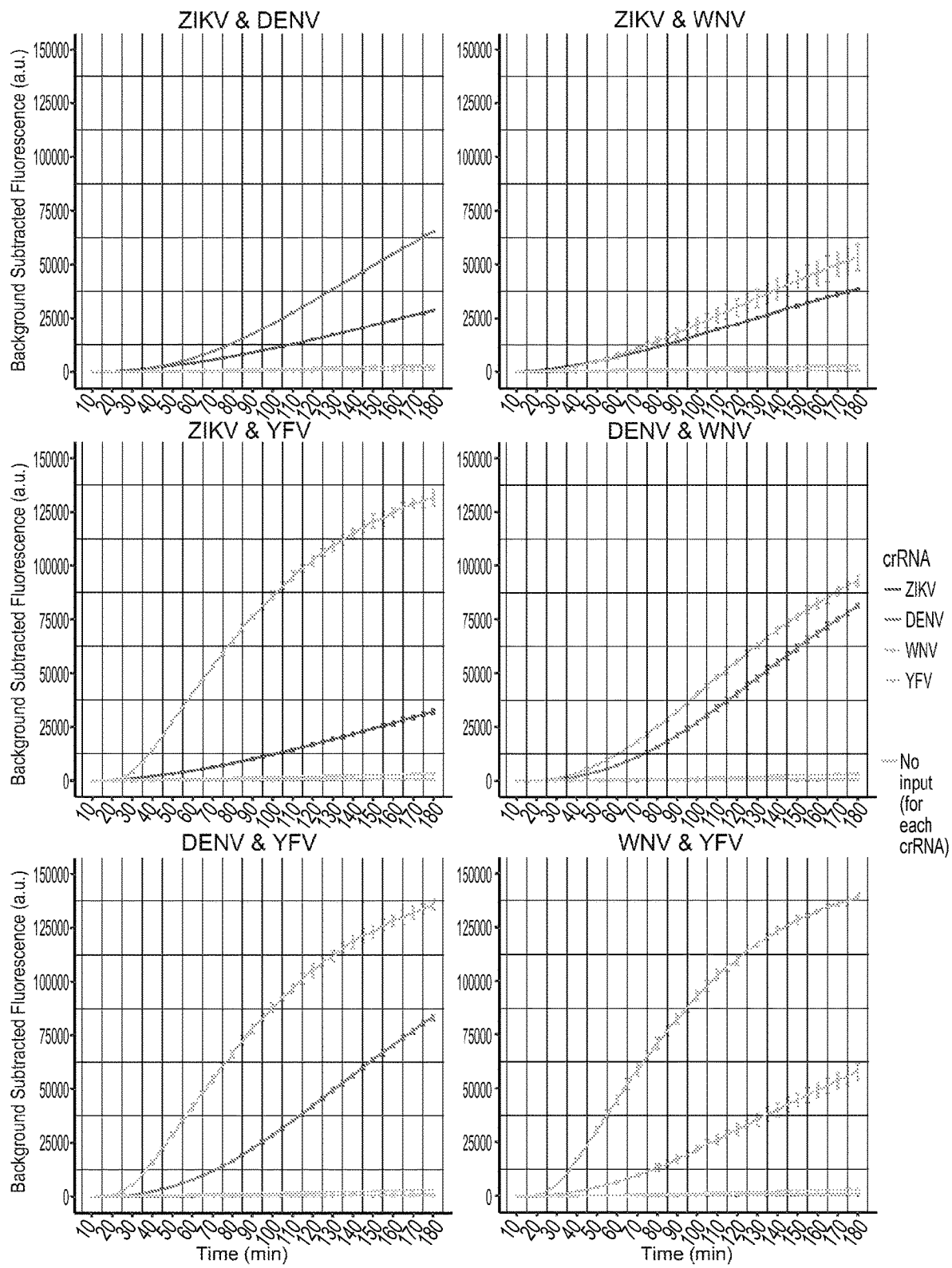
FIG. 93—Flavivirus panel co-infection time course. Each panel shows the background-corrected fluorescence for all crRNAs against sample with two flavivirus targets over a 3-hour time course with fluorescence measurements every 5 minutes. Each panel also includes the background-corrected fluorescence observed for each crRNA against the no input control. Error bars are 1 S.D. based on 3 technical replicates.

Many genetically and antigenically similar Flaviviruses co-circulate within the Americas and Africa; therefore, Applicants expanded SHERLOCK by developing diagnostic panels to detect related viral species and differentiate between viral serotypes. Using a probe design algorithm developed in the lab, Applicants are able to quickly identify regions within ZIKV, Dengue virus (DENV), West Nile virus (WNV), and Yellow Fever Virus (YFV) that are conserved enough to serve as universal-Flavivirus RPA primer regions. In this way, a single pair of RPA primers can amplify any of the four viruses and then species-specific crRNAs can detect which virus or viruses are present in a given sample (FIG. 84A). Applicants found the universal Flavivirus RPA primers and virus-specific crRNAs were able to detect the presence of synthetic ZIKV, DENV, WNV, and YFV DNA targets in a highly specific manner with <0.22% cross-reactivity (FIG. 84B, FIG. 92). This assay can also detect the presence of all pairwise combinations of flaviviruses, demonstrating its ability to detect mock co-infections (FIG. 84C, FIG. 93). In addition to specifically detecting related viruses, Applicants designed SHERLOCK panels to distinguish between different DENV serotypes using DENV-specific RPA primers and serotype-specific crRNAs (FIG. 84D). Applicants were able to distinguish between DENV serotypes 1-4 with <3.2% cross-reactivity (FIG. 84E, FIG. 94). SHERLOCK can therefore be extended to detect and differentiate between related viruses or serotypes without a need for virus- or serotype-specific RPA primers.

SHERLOCK is uniquely poised for field-deployable variant identification. Single nucleotide polymorphisms (SNPs) identification typically involves the use of sequencing technologies that require extensive sample processing and are difficult to deploy in the field. SHERLOCK can be used for SNP identification by placing the SNP in the 3rd position of the crRNA and a synthetic mismatch in the 5th position of the crRNA (FIG. 85A) (Gootenberg et al. 2017). Applicants designed SHERLOCK diagnostics for 3 region-specific SNPs from the 2016 ZIKV outbreak (FIG. 85B). Applicants validated the performance of each of these assays on synthetic targets and an ancestral viral seedstock (FIG. 85C). To genotype samples, Applicants take the ratio of the fluorescence of the derived crRNA (FIG. 85A, dark bars) over that of the ancestral crRNA (FIG. 85A, light bars). This ratio should be greater than 1 for samples containing the SNP, and less than 1 for samples that do not contain the SNP. Applicants tested the SNP assays on cDNA samples from patients from Honduras and the Dominican Republic, and a mosquito pool from the United States (FIG. 85D). Applicants observed the expected fluorescence ratios, as shown in the bar plots (FIG. 85D) and heatmaps (FIG. 85E). These results highlight the single-nucleotide specificity of SHERLOCK.

Finally, Applicants demonstrated that SHERLOCK can be rapidly adapted to identify emerging functional mutations.

Within 1 week of publication of a report describing a ZIKV point mutation in prM (S139N) that contributes to fetal microcephaly (Yuan et al. 2017) (FIG. 95), Applicants designed, ordered, and successfully tested a SHERLOCK diagnostic that could distinguish nucleic acid sequences with or without the S139N mutation (FIG. 85F). Applicants tested an alternative crRNA design (no synthetic mismatches and the SNP at position 7) that could also distinguish the 139S and 139N alleles (FIG. 96). To further illustrate the ease of developing new SHERLOCK diagnostics for clinically relevant mutations, Applicants developed assays for the six most commonly observed drug-resistance mutations in HIV reverse transcriptase (FIG. 97) within 1 week. These developments underscore the adaptability and specificity of the SHERLOCK platform.

Applicants have demonstrated a variety of useful features of viral SHERLOCK diagnostics including sensitivity, speed, user friendliness, and the ability to multiplex viral diagnostic panels and the ability to genotype clinically-relevant SNPs. The rapid turnaround time and low requirements for sample processing should enable field testing of SHERLOCK in the near future. In addition, SHERLOCK diagnostics should be easy to develop for a wide variety of viral diseases, including hemorrhagic fevers, sexually transmitted infections, and respiratory illnesses, as well as emerging viral pathogens.

Example 8—Methods

Clinical samples/ethics statement. Clinical samples used for this study were from clinical studies evaluated and approved by the Institutional Review Boards/Ethics Review Committees at Hospital General de la Plaza de la Salud (Santo Domingo, Dominican Republic), Florida Department of Health (Tallahassee, Florida), and Universidad Nacional Autonoma de Honduras (Tegucigalpa, Honduras). Massachusetts Institute of Technology (MIT) Institutional Review Board/Ethics Review Committee and the Office of Research Subject Projection at the Broad Institute provided approval for use of samples collected by the previously listed institutions.

Production of LwCas13a and crRNAs. LwCas13a was purified as described (Gootenberg et al. 2017). crRNA DNA templates were annealed to a T7 promoter oligonucleotide at a final concentration of 10 µM in 1× Taq reaction buffer (NEB). This involved 5 minutes of denaturation at 95° C. followed by an anneal at 5° C. per minute down to 4° C. crRNAs were transcribed in vitro using the HiScribe T7 High Yield RNA Synthesis Kit (NEB). Transcriptions were performed according to the manufacturer's instructions for short RNA transcripts, with the volume scaled to 30 µl. Reactions were incubated overnight at 37° C. Transcripts were purified using RNAClean XP beads (Beckman Coulter) with a 2× ratio of beads to reaction volume and an additional supplementation of 1.8× isopropanol.

Sample preparation. Viral RNA was extracted from 140 µl of input material using the QIAamp Viral RNA Mini Kit (QIAGEN) with carrier RNA according to the manufacturer's instructions. Samples were eluted in 60 µl and stored at −80° C.

To produce cDNA, 5 µL of extracted RNA was converted into single-stranded cDNA using methods published previously (Matranga et al. 2014). In short, RNA was reverse transcribed with SuperScript III and random hexamer primers. RNA-DNA duplexes were then degraded with RNase H.

A single cultured isolate, ZIKV Pernambuco (isolate PE243, KX197192.1), was used as a positive control or as a control for the ancestral sequence in ZIKV detection experiments. Viral RNA was extracted from the seed stock sample.

RNase inactivation of urine samples was performed by addition of TCEP/EDTA and heating samples. TCEP and EDTA were added to urine samples at final concentrations of 100 mM and 1 mM respectively. Two protocols were used: 1-step inactivation at 95° C. for 10 minutes, or 2-step inactivation at 50° C. for 20 minutes followed by 95° C. for 5 minutes. Inactivations were performed using a thermocycler (Eppendorf MasterCycler) or a dry heat block.

RPA reactions and primer design. For RPA reactions, the Twist-Dx RT-RPA kit was used according to the manufacturer's instructions. Primer concentrations were 480 nM. For amplification reactions involving RNA, Murine RNase inhibitor (NEB M3014L) was used at a final concentration of 2 units per microliter.

For ZIKV detection, RPA primers RP819/RP821 from a recent publication (Gootenberg et al. 2017) were used. For the Flavivirus panel, RPA primers FLAVI-NS5fwd-1/FLAVI-NS5rev-1 were used. For the Dengue virus panel, RPA primers DENV-3UTRfwd-1/DENV-3UTRrev-1 were used. For region-specific Zika SNP detection, RPA primers DOMUSA-5249-fwd/DOMUSA-5249-rev (DOMUSA5249 SNP), USA-935-fwd/USA-935-rev (USA935 SNP), and HND-2788-fwd/HND-2788-rev (HND2788 SNP) were used. For detecting a Zika SNP associated with microcephaly, RPA primers ZIKV-mcep-fwd and ZIKV-mcep-rev were used. For detecting drug-resistance SNPs in HIV reverse transcriptase, RPA primers HIVRT-149F/HIVRT-348R (K65R, K103N, and V106M SNPs), and HIV-462F/HIVRT-601R (Y181C, M184V, and G190A SNPs) were used.

Cas13a detection reactions and crRNA design. Detection reactions were performed as described (Gootenberg et al. 2017), except that 25 ng of background RNA was used rather than 100 ng. This increases the reaction rate without introducing any spurious cleavage of the reporter oligonucleotide. Unless indicated otherwise, RNase Alert v2 (Thermo) was used as the reporter. Biotek microplate readers (Synergy H4, Neo2, and Cytation 5) were used for measuring fluorescence of the detection reaction. Fluorescence kinetics were monitored using a monochromator with excitation at 485 nm and emission at 520 nm with a reading every 5 minutes for up to 3 hours. Applicants did not observe significant differences in sensitivity between the different machines.

For ZIKV detection, the crRNA "Zika targeting crRNA 2" from a recent publication (Gootenberg et al. 2017) was used. For the Flavivrus panel, crRNAs ZIKV-NS5at9227 (ZIKV), DENV-NS5at9127 (DENV), WNV-NS5at9243 (WNV), and YFV-NS5at9122 (YFV) were used. For the Dengue virus panel, crRNAs D1-3UTRat10457 (DENV1), D2-3UTRat10433 (DENV2), D3-3UTRat10419 (DENV3), and D4-3UTRat10366 (DENV4) were used. For region-specific Zika SNP detection, crRNAs DOMUSA-5249-ancestral/DOMUSA-5249-derived (DOMUSA5249 SNP), USA-935-ancestral/USA-935-derived (USA935 SNP), and HND-2788-ancestral/HND-2788-derived (HND2788 SNP) were used. For detecting a Zika SNP associated with microcephaly, crRNAs ZIKV-mcep-snp3syn5-ancestral/ZIKV-mcep-snp3syn5-derived (design shown in FIG. 85F), and crRNAs ZIKV-mcep-snp7-ancestral/ZIKV-mcep-snp7-derived (design shown in FIG. 96) were used. For detecting drug-resistance SNPs in HIV reverse transcriptase, crRNAs HIVRT-K65R-ancestral/HIVRT-K65R-derived (K65R SNP), crRNAs HIVRT-K103N-ancestral/HIVRT-K103N- derived (K103N SNP), crRNAs HIVRT-V016M-ancestral/HIVRT-V106M-derived (V106M SNP), crRNAs HIVRT-Y181C-ancestral/HIVRT-Y181C-derived (Y181C SNP), crRNAs HIVRT-M184V-ancestral/HIVRT-M184V-derived (M184V SNP), and crRNAs HIVRT-G190A-ancestral/HIVRT-G190A-derived (G190A SNP) were used.

Data analysis. Background correction was performed by subtracting the fluorescence values after 10 minutes (FIGS. 82-84) or 20 minutes (FIG. 85), when minimum fluorescence was observed. For both the Flavivirus panel and the Dengue virus panel, background corrected fluorescence was normalized to target-specific fluorescence. Target specific fluorescence is the mean background corrected fluorescence of the no input (water) control with a given crRNA subtracted from the background corrected fluorescence of a given DNA target with the same crRNA at each time point.

Figure 87A:
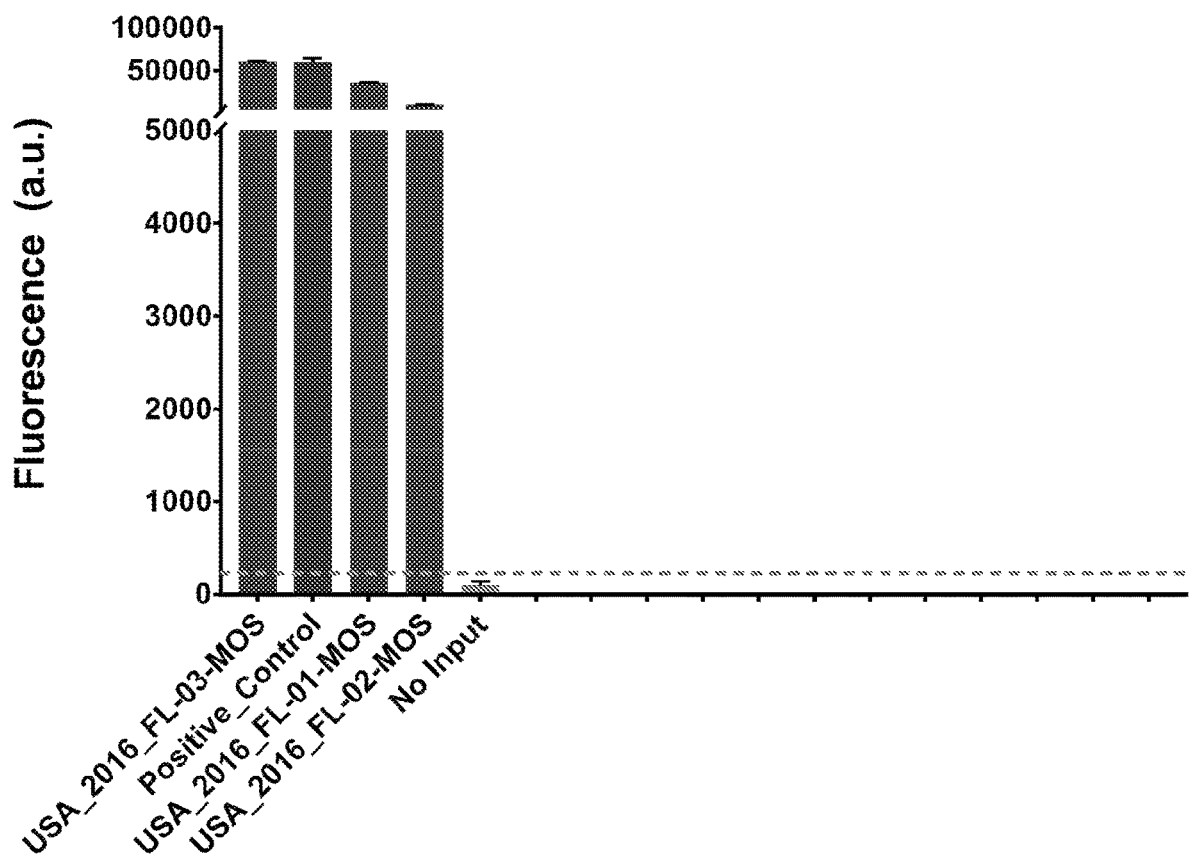
FIG. 87—(A-D) SHERLOCK fluorescence data at 1 hour for 40 cDNA samples from the 2016 ZIKV outbreak. Sample names indicate country of origin, sample collection year, followed by the sample name and sample type. Sample types are as indicated: PLA: plasma sample, SER: serum sample, URI: urine sample, MOS: mosquito pool. Countries of origin are indicated using abbreviations: HND: Honduras, DOM: Dominican Republic, USA: United States. Error bars indicate 1 S.D. based on 3 technical replicates. The positive control (purple) shown in each plot is a cultured viral seed stock (PE243). Negative controls are shown in orange.
Figure 87B:
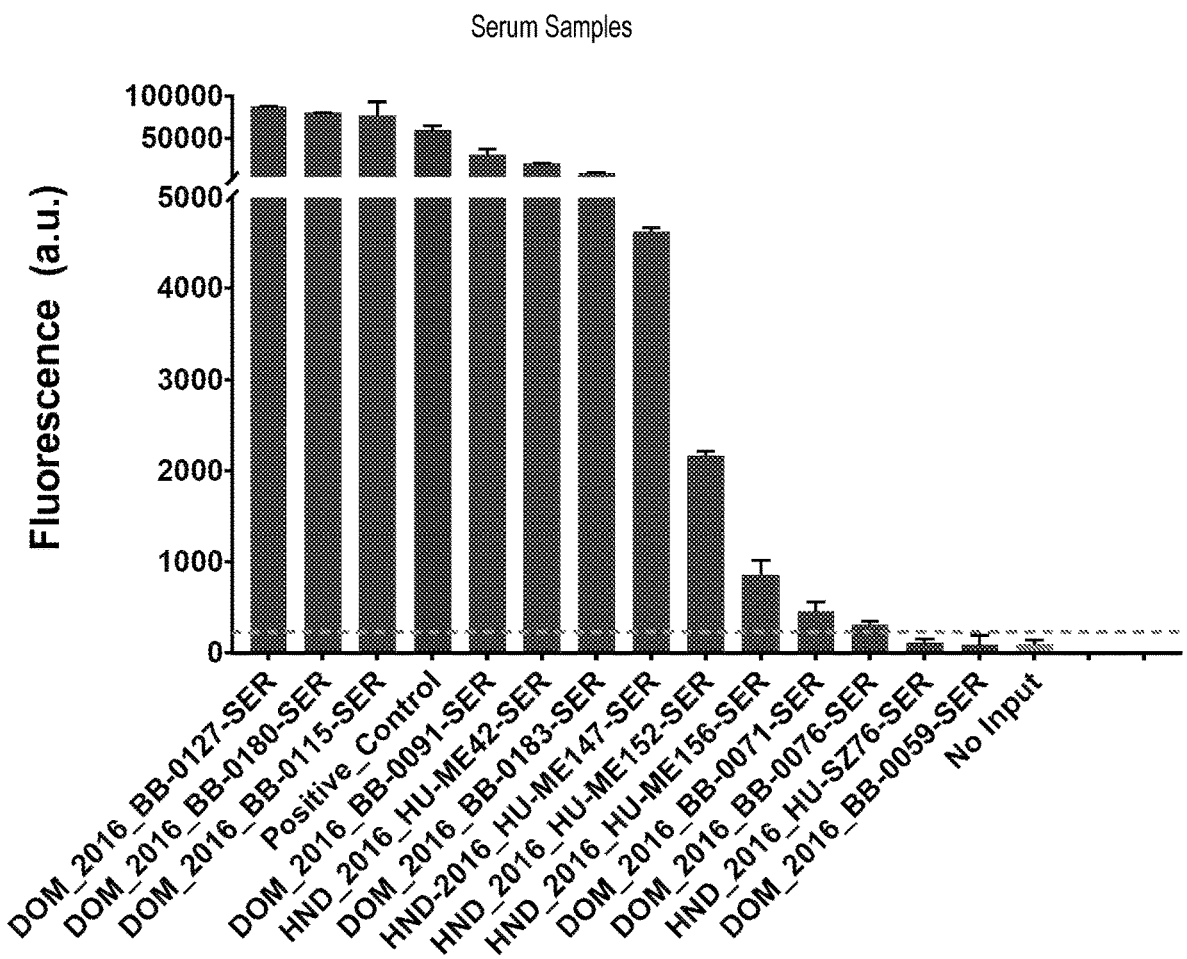
Figure 87C:
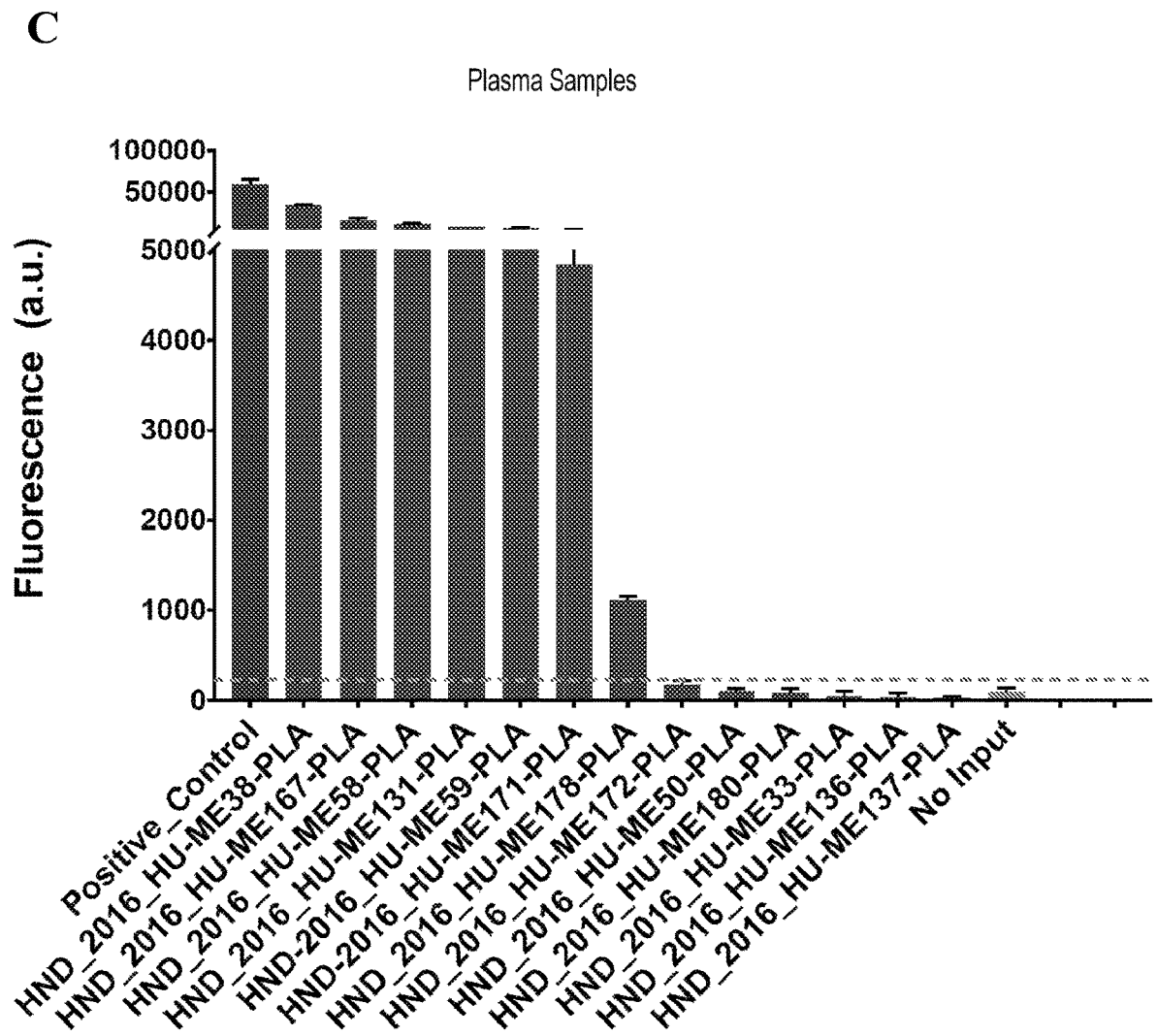
Figure 87D:
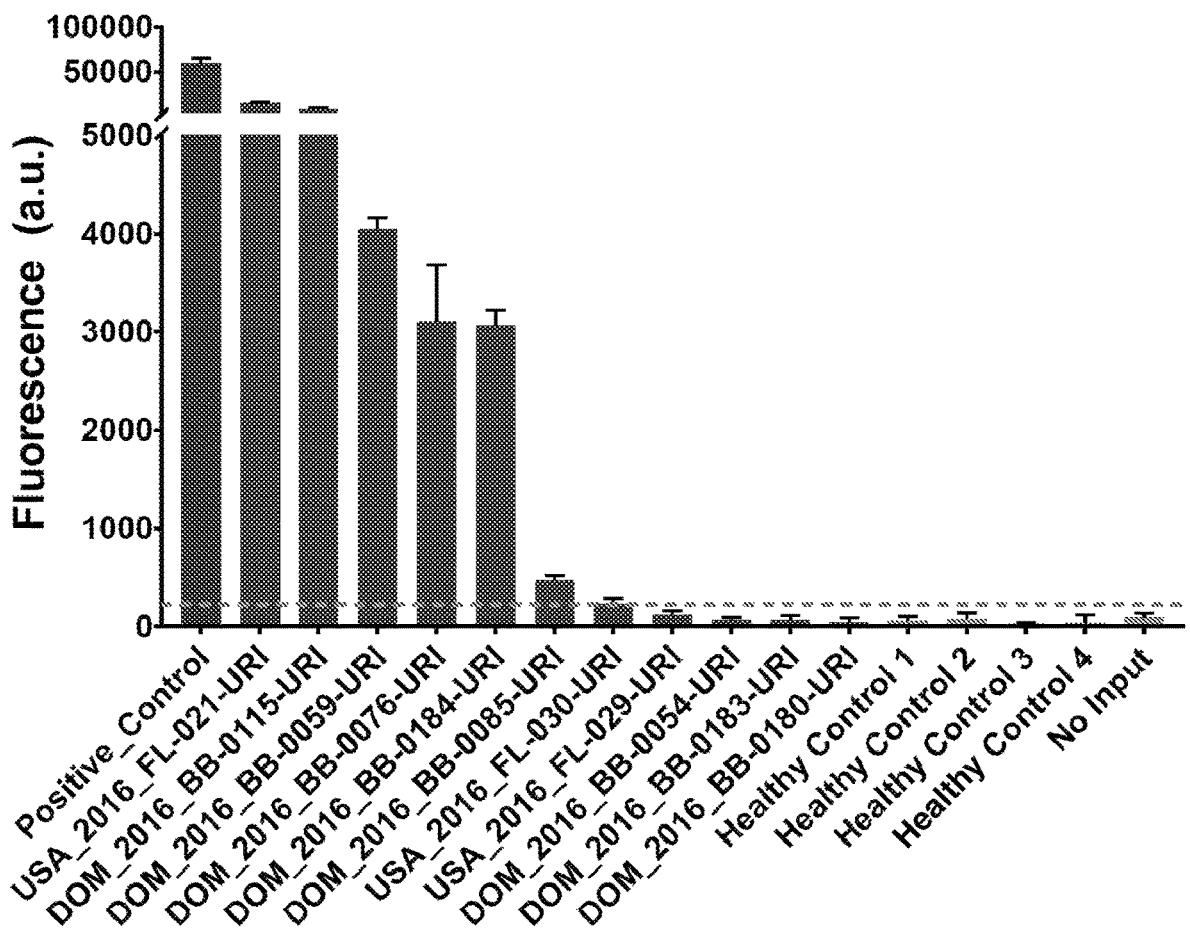
Figure 88A:
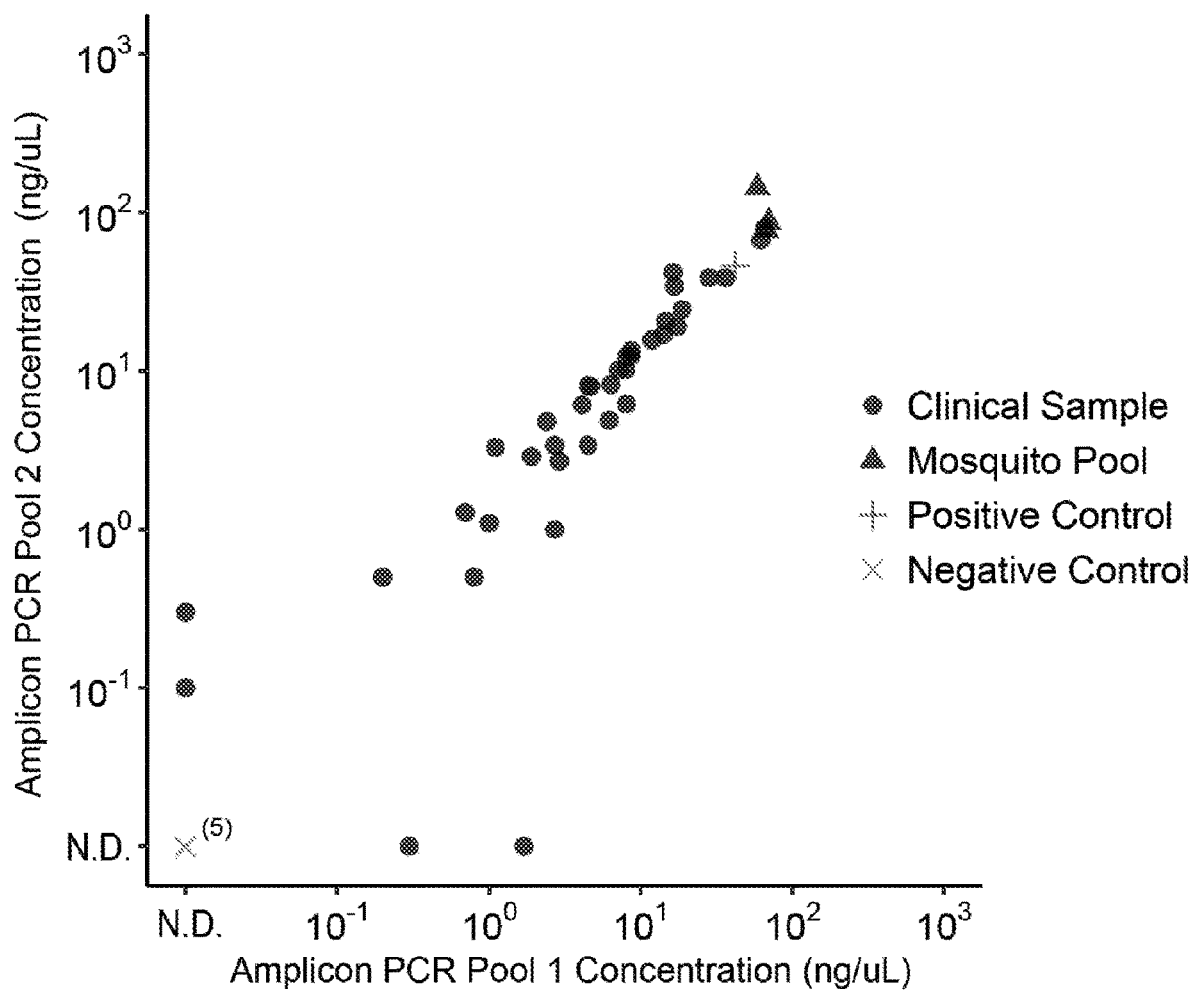
FIG. 88—Amplicon PCR primer pool data and thresholding. (A) A scatterplot of ng/μL concentrations (measured by Agilent tapestation) from each of the 2 amplicon PCR primer pools for each cDNA sample. In some cases, data points are nearly superimposed, indicated by a number in parentheses. N.D.: not detected. The positive control (purple cross) is a cultured viral seed stock (PE243) and the negative controls (orange x) include 1 no input control and 4 single donor healthy urine samples. (B) A scatterplot of the amplicon PCR yield (in ng/μl) versus the genome coverage from the recent Zika sequencing efforts (Metsky et al. 2017). The amplicon PCR yield is defined as the minimum amplicon DNA concentration of the two amplicon PCR pools (measured by Agilent tapestation). Genome coverage is normalized to 1. Technical replicates of sequencing libraries are shown as separate circles. (C) Applicants show the precision (true positives divided by the sum of true positives and false positives), recall (sensitivity), and the $F_{0.5}$ statistic for varying amplicon PCR yield thresholds. The threshold for the amplicon PCR yield was selected to maximize the $F_{0.5}$ statistic.

For the analysis of ZIKV samples from the 2016 outbreak (FIG. 82), thresholds were used to determine the presence or absence of ZIKV. The SHERLOCK fluorescence threshold was determined using background-subtracted fluorescence from 5 samples: 4 single-donor healthy human urine samples and one no-input water control. Namely, for each sample s of these 5, Applicants took the mean $m_s$ and standard deviation us of the fluorescence across 3 technical replicates. The threshold was set to the median of the 5 values $\{m_s+3\sigma_s\}$. The threshold on amplicon PCR yield was determined using information from genome assemblies. First, the amplicon PCR yield was calculated for each sample by taking the minimum concentration from each of the two amplicon PCR pools (FIG. 87A). The objective is then to determine a yield that best predicts whether a particular targeted portion r of the genome is present in a sample (in this case, the RPA amplicon Applicants are detecting with SHERLOCK). The probability that r is present in a sample s, $Pr_s(r)$, can be estimated as the fraction of the ZIKV genome that was sequenced and assembled from cDNA of s. (Calculating a probability across the genome is preferable to simply looking at whether there is coverage in the genome at r because lack of coverage does not necessarily indicate that r is not present.) The data for this analysis are from individual technical replicates from a recent genome sequencing study of the ZIKV outbreak (Metsky et al. 2017). A plot of amplicon PCR yield vs. fraction of the genome covered is shown in FIG. 87B. The values $Pr_s(r)$ can be used to estimate precision and recall for a choice of threshold. In particular, an estimate of the number of samples that do have r is the sum of $Pr_s(r)$ across all samples. Similarly, among the samples P whose amplicon PCR yield exceeds a given threshold, the number that are correctly labeled as having presence of r is estimated as the sum of $Pr_s(r)$ across the samples in P. FIG. 87C shows precision and recall for each choice of threshold, as well as the $F_{0.5}$ score, which is a composite metric that takes into account the threshold's ability to accurately classify samples as having the targeted portion of ZIKV. The amplicon PCR yield threshold was set to maximize the $F_{0.5}$ score.

For SNP identification, background-subtracted fluorescence values were calculated using ancestral-targeting and derived-targeting crRNAs. Applicants took the ratio of the derived background-subtracted fluorescence to the ancestral background-subtracted fluorescence to determine the presence or absence of a SNP. For the HIV SNPs (FIG. 97), Applicants calculated the SNP identification index, which is the ratio of the fluorescence ratio for the derived allele divided by the fluorescence ratio for the ancestral allele. The SNP identification index is equal to 1 if there is no discriminatory power between the two alleles and increases as the fluorescence ratios between the two alleles diverge.

ZIKV detection experiments. PE243 seedstock cDNA was used at a stock concentration of $6.8 \times 10^4$ cp/ul. cDNA was serially diluted 1:10 in ultrapure water (Life Technologies), or healthy urine (Lee Biosolutions). 4-8 µl of each sample was inactivated, and 1-2 µl was used as input for RPA reactions. PE243 seedstock RNA was used at $2.72 \times 10^5$ cp/ul. RNA was serially diluted 1:10 in ultrapure water (Life Technologies), or healthy urine (Lee Biosolutions). 4-8 µl of each sample was inactivated, and 1-2 µl was used as input for RPA reactions.

Cultured isolate, strain PRVABC59 (KU501215), was used for the viral particle experiments. PRVABC59 was cultured in insect and non-human primate cell lines and the original stock was purchased from ATCC (ATCC VR-1843).

Viral panel experiments. For both the Flavivirus panel and Dengue virus panel, synthetically derived DNA templates were used as input at a concentration of $10^4$ copies/L. A no input (water) control was used as a negative control for each of the crRNAs tested. In all experiments, the MgAc concentration in the RPA reaction was increased to 20 mM and three technical replicates were used.

For the Flavivirus panel, ZIKV template sequence was derived from (KX197192), DENV (NC_001477.1), WNV (NC_09942.1), and YFV (AY968065.1). The RPA reaction amplifies a portion of NS5 for these Flaviviruses.

For the Dengue virus panel, the DENV1 template sequence was derived from (KM204119.1), DENV2 (KM204118.1), DENV3 (KU050695.1), DENV4 (JQ822247.1). The RPA reaction amplifies a portion of the 3'UTR region of DENV1-4.

SNP identification experiments. For region-specific SNP identification, synthetic templates containing 400-nt fragments of the ZIKV genome with ancestral or derived alleles were used to validate the performance of the SNP identification assay. In addition, ZIKV cDNA samples from 3 countries (USA, Honduras, and Dominican Republic) were used to confirm performance on mosquito pools and clinical samples. PE243 seedstock cDNA (KX197192.1) was used as an outgroup control at 300 cp/µl. In addition, a no input (water) control was used. For the microcephaly-associated SNP identification experiments, synthetic templates containing a 400-nt fragment of the ZIKV genome with ancestral or derived alleles were used at $10^4$ cp/µl, and PE243 seedstock cDNA was used at 300 cp/µl. For the HIV drug resistance SNP identification experiments, synthetic templates containing 468-nt fragments of the HIV genome with ancestral or derived alleles were used at $10^4$ cp/µl. In all SNP identification experiments, 3 technical replicates were used.

Example 9—Programmable Cas13-Based Antiviral Therapeutics and Companion Diagnostics Infectious diseases threaten our health and security, yet gold standard diagnostic and treatments have limited effectiveness and are based on decades-old science and systems. The vast majority of infectious diseases go undiagnosed and untreated, and outbreaks take far too long to detect. Nucleic-acid based diagnostics have been approved for only eleven viruses, and just nine viral diseases can be addressed with FDA-approved antiviral therapies (De Clercq and Li, 2016). This means we can diagnose and treat fewer than 10% of the viral pathogens known to infect humans (Hulo et al., 2011). Furthermore, viruses can rapidly evolve resistance to therapy, limiting the efficacy of our existing antiviral arsenal. There is an urgent need to develop new tools that can rapidly and accurately diagnose infectious illness anywhere in the world, identify and track both known and new infectious threats, and develop antiviral treatments that can be informed by diagnostics.

Applicants recently discovered CRISPR-Cas13 systems that can be leveraged to detect and cleave specific RNA sequences and have demonstrated their potential applications for infectious diseases (Abudayyeh et al., 2016; Gootenberg et al., 2017). Cas13 is an RNA-guided, RNA-targeting CRISPR effector that exhibits ribonuclease activity upon RNA target recognition, such as pathogen nucleic acid. By programming CRISPR-Cas13 systems that directly target viral RNA, Applicants can develop highly multiplexed antiviral therapies as well as viral diagnostics. CRISPR-Cas13 systems are thus primed for application to RNA viruses and could be a more specific alternative to qPCR diagnostics and shRNA therapeutics.

Here Applicants provide a new approach to addressing the described deficiencies in diagnosing and treating patients with viral infections. Applicants will use Cas13-based systems to develop programmable therapies to counter viral threats and prevent the evolution of drug resistance. In addition, Applicants will create fast, sensitive, and low-cost companion diagnostics to identify specific pathogen sequences, including specific polymorphisms (e.g., drug-resistant mutations). This will demonstrate a powerful, adaptive strategy to inhibit viral replication and will highlight the importance of Cas13 for developing new diagnostic and therapeutic applications. More broadly, similar approaches can position Cas13-based systems as a new frontline tool to both rapidly identify infectious agents and treat patients.

Antiviral drugs do not exist for most emerging viruses, and available direct-acting antivirals, which include small molecules, short interfering RNAs, and antibodies, typically target a small number of highly mutable viral proteins or RNAs. This is problematic because RNA viruses evolve rapidly and can easily acquire resistance to existing therapeutics. Cas13-based systems offer highly multiplexed, programmable antiviral therapies that directly target viral RNA, and can be flexibly adapted to target novel viruses or emerging outbreak pathogens. Cas13-based therapies can be used in combination with existing antiviral compounds for viruses where such compounds exist, thereby reducing the prevalence of specific drug resistance mutations. Perhaps most importantly, if a virus evolves resistance to a specific Cas13 guide RNA sequence, it is easy to switch to a different guide RNA sequence or design a new guide sequence to target the new mutation. Such approaches should prevent the widespread development of resistance to Cas13-based therapies and address a common challenge faced by current antiviral therapies.

Current gold-standard pathogen diagnostics are often expensive, slow, and lack sufficient sensitivity to detect viral infections. Standard molecular amplification methods, such as RT-qPCR, typically require nucleic acid extraction and expensive thermocycling machinery. Immunoassays, such as ELISAs, can only detect single targets, cross-react to antigenically similar targets, and cannot be quickly developed or updated to deal with new or evolving threats. The novel CRISPR-based platform (SHERLOCK) can transform the diagnosis of viral diseases with single-molecule detection sensitivity and single nucleotide polymorphism specificity (Gootenberg et al., 2017). Applicants can adapt SHERLOCK for use as a companion diagnostic to inform Cas13-based therapies. To do this, Applicants can reduce the turnaround time to <1 hour with high performance by adapting the technology to use clinical samples as input directly instead of purified nucleic acids. Furthermore, Applicants will develop specific Cas13-based diagnostics that will identify known or predicted therapy resistant mutations. These features will allow Cas13-based diagnostics to complement the therapeutic uses.

Cas13-based systems for the development of therapeutics may raise concerns for potential off-target effects as has been noted for Cas9. Cas9's many applications relate to its ability to make edits in the DNA which then encode a permanent and heritable change. Cas13, in contrast, has different applications because it targets RNA, and the guide-directed changes are not heritable. Even though Cas13-directed changes are not heritable, Cas13 can still be used to regulate, detect, or image RNA molecules inside or outside of cells showcasing its strength as a tool for studying viral diseases.

Applicants will develop a set of Cas13 orthologs and corresponding guide RNA sequences that efficiently inhibit the replication of two mammalian viruses: Lymphocytic Choriomeningitis Virus (LCMV) and Influenza. In addition, Applicants will perform pilot experiments to test delivery methods for Cas13, screen for off-target activity of Cas13, and study viral evolution and guide-resistance in response to Cas13 therapy. Applicants will develop improved diagnostic protocols for rapid turnaround time, assay designs for detecting Influenza and differentiating between Influenza A, B, and C, and a lateral flow assay for instrument-free diagnostics.

The SHERLOCK diagnostic platform has the potential to revolutionize infectious disease testing, as a fast, broad-spectrum, field-deployable diagnostic. The evaluation of its technical progress and commercialization potential will be framed within the context of existing common diagnostic approaches, such as immunoassays and nucleic acid amplification strategies. Thus, at the stages of development we will evaluate its performance metrics, including sensitivity and specificity, time to results, cost per reaction, temperature stability, exogenous equipment requirements, and ease of use and interpretation. Preliminary results suggest that SHERLOCK will compare favorably to existing FDA approved pathogen diagnostic approaches.

There are five key technical challenges related to this approach: the efficacy of individual guide RNAs, the evolution of guide resistance, off-target nuclease activity, the ease of targeting influenza replication, and the sensitivity of companion Cas13-based diagnostics.

The first technical challenge is to ensure a high efficacy of targeting viral genomes by individual guide RNAs. Unlike messenger RNAs, which are produced from the genome at specific rates determined by promoter strength, viral genomes replicate exponentially. To properly inhibit viral replication, Cas13-mediated cleavage activity must outweigh the rate of synthesis of new viral genomes. Applicants can apply two approaches to mitigate this risk and ensure highly effective genome cleavage: screening Cas13 orthologs to find orthologs with higher nuclease activity, and screening viral genomes to find optimal guide sequences. These results can be combined to yield even higher targeting efficiency. By optimizing for nuclease activity of Cas13 orthologs and screening optimal guide sequences, Applicants plan to achieve viral replication knock-down of at least 10-fold. By combining multiple guides simultaneously, Applicants plan to achieve a viral replication knockdown of at least 20-fold.

A second technical challenge is that viruses could evolve resistance to guide targeting. This could occur either by direct mutations in the target site, or via mutations in other parts of the genome that compensate for the effect of target cleavage. RNA viruses are known to have a relatively high mutation rate of approximately $10^{-4}$ substitutions per base per generation (Sanjuan et al., 2010). Given that the guide RNAs typically target a 28-nucleotide region of the viral genome, this means that the probability of a single mutation in a target region is approximately $3 \times 10^{-3}$. Applicants know from previous characterization of Cas13 that two mutations in a target region are required to prevent target cleavage (Abudayyeh et al., 2016). Assuming the two mutations occur independently, the probability of guide resistance arising in a single region is approximately $10^{-10}$. These calculations illustrate the importance of guide pooling, as pools of guides should further decrease the probability of resistance evolution in a multiplicative fashion (e.g., for 2 guides: $10^{-10}$, for 3 guides, $10^{-15}$). In addition to guide pooling, Applicants will specifically address this challenge by sequencing viral populations before and after Cas13-based therapy to map the evolution (if present) of therapy resistance.

A third technical challenge is off-target nuclease activity by Cas13. Off-target nuclease activity is a concern because it could induce side effects in animal models or in patients. However, it is important to distinguish between the relative effects of off-target cleavage by Cas13 and Cas9. Since Cas9 targets DNA, any off-target cleavage events will lead to permanent changes to the genomes of affected cells. Cas13, however, targets RNA and therefore off-target cleavage will have only a transient effect on gene expression, as the half-life of messenger RNAs tends to be less than 24 hours (Yang et al., 2003). Despite this contrast between Cas13 and Cas9, Applicants have can sequence the transcriptomes of cells in the presence and absence of Cas13 cleavage to measure any off-target cleavage activity of Cas13. Specifically, Applicants will compare the off-target effects between Cas13 guides and siRNAs targeting the luciferase transcript by sequencing. If off-target effects are guide specific, then Applicants will also assess off-target effects of the best targeting guides. Applicants expect Cas13 to have at least 2-fold lower off-target cleavage activity than siRNAs.

A fourth technical challenge is the ability to target Influenza A. In contrast to LCMV, Influenza A replicates its genome in the nucleus of an infected cell and the genome is complexed with Influenza A proteins to form ribonucleoproteins (RNPs) (Knipe and Howley, 2007). Applicants can optimize the targeting of Influenza A through pilot experiments with a few guides that are derived from previously published shRNAs (Wang et al., 2017; Huang et al., 2017; Stoppani et al., 2015; Xu et al., 2015; Wang et al., 2016; McMillen et al., 2016) before proceeding to a comprehensive full-genome screen. Specifically, Applicants can optimize the localization of Cas13 (nucleus versus cytosol) and discern whether designing guides to target the positive sense mRNA is a more effective strategy as this RNA species is free from RNPs and could therefore more easily be targeted. If those strategies do not achieve the goal targeting efficiency, Applicants can fuse Cas13 with another protein to destabilize these RNPs, similar to strategies for altering Cas9's function through the creation of fusion proteins (Dominguez et al., 2016). Current nucleic acid targeting strategies for Influenza have included siRNAs, which have been reported to exhibit 80%-95% knockdown or at least a 5-fold reduction in Influenza replication in cell culture models (Huang et al., 2017; Xu et al., 2015). Applicants can achieve similar or increased levels of viral replication reduction, specifically>5 fold, using either a single guide or multiple guides targeting Influenza.

A final technical challenge is the sensitivity of the companion Cas13-based diagnostic. This is important to ensure that a virus can be detected before it becomes widespread in a patient. This is especially relevant in the context of therapy resistance mutations, which are initially difficult to detect at low frequencies, but much easier to detect at high frequencies. Unfortunately, by the time therapy resistance mutations reach high frequencies in a patient, the damage has already been done. A more sensitive, rapid Cas13-based diagnostic would enable faster detection. For these reasons, Applicants have set a very stringent threshold of 50 aM (25 copies per microliter) for the Cas13-based Influenza diagnostic. This threshold is substantially lower than the median Influenza A titer in nasal swabs, which is 104 RNA copies per microliter (Ngaosuwankul et al., 2010).

References

Abudayyeh, O. O., Gootenberg, J. S., Konermann, S, Joung, J, Slaymaker, I. M., Cox, D. B. T., Shmakov, S, Makarova, K. S., Semenova, E, Minakhin, L., et al. (2016). C2c2 is a single-component programmable RNA-guided RNA-targeting CRISPR effector. Science 353, aaf5573.

Andersen, K. G., Shapiro, B. J., Matranga, C. B., Sealfon, R, Lin, A. E., Moses, L. M., Folarin, O. A., Goba, A, Odia, I, Ehiane, P. E., et al. (2015). Clinical Sequencing Uncovers Origins and Evolution of Lassa Virus. Cell 162, 738-750.

Cong, L, Ran, F. A., Cox, D, Lin, S, Barretto, R, Habib, N, Hsu, P. D., Wu, X, Jiang, W, Marraffini, L. A., et al. (2013). Multiplex genome engineering using CRISPR/Cas systems. Science 339, 819-823.

De Clercq, E, and Li, G. (2016). Approved Antiviral Drugs over the Past 50 Years. Clin. Microbiol. Rev. 29, 695-747.

Dominguez, A. A., Lim, W. A., and Qi, L. S. (2016). Beyond editing: repurposing CRISPR-Cas9 for precision genome regulation and interrogation. Nat. Rev. Mol. Cell Biol. 17, 5-15.

Gire, S. K., Goba, A, Andersen, K. G., Sealfon, R. S. G., Park, D. J., Kanneh, L, Jalloh, S, Momoh, M, Fullah, M, Dudas, G., et al. (2014). Genomic surveillance elucidates Ebola virus origin and transmission during the 2014 outbreak. Science 345, 1369-1372.

Gootenberg, J. S., Abudayyeh, O. O., Lee, J. W., Essletzbichler, P, Dy, A. J., Joung, J, Verdine, V, Donghia, N, Daringer, N. M., Freije, C. A., et al. (2017). Nucleic acid detection with CRISPR-Cas13a/C2c2. Science 356, 438-442.

Huang, D. T.-N., Lu, C.-Y., Shao, P.-L., Chang, L.-Y., Wang, J.-Y., Chang, Y.-H., Lai, M.-J., Chi, Y.-H., and Huang, L.-M. (2017). In vivo inhibition of influenza A virus replication by RNA interference targeting the PB2 subunit via intratracheal delivery. PLoS One 12, e0174523.

Hulo, C, de Castro, E, Masson, P, Bougueleret, L, Bairoch, A, Xenarios, I, and Le Mercier, P. (2011). ViralZone: a knowledge resource to understand virus diversity. Nucleic Acids Res. 39, D576-D582.

Knipe, D. M., and Howley, P. M. (2007). Fields' Virology (Lippincott Williams & Wilkins).

McMillen, C. M., Beezhold, D. H., Blachere, F. M., Othumpangat, S, Kashon, M. L., and Noti, J. D. (2016). Inhibition of influenza A virus matrix and nonstructural gene expression using RNA interference. Virology 497, 171-184.

Metsky, H. C., Matranga, C. B., Wohl, S, Schaffner, S. F., Freije, C. A., Winnicki, S. M., West, K, Qu, J, Baniecki, M. L., Gladden-Young, A., et al. (2017). Zika virus evolution and spread in the Americas. Nature 546, 411-415.

Ngaosuwankul, N, Noisumdaeng, P, Komolsiri, P, Pooruk, P, Chokephaibulkit, K, Chotpitayasunondh, T, Sangsajja, C, Chuchottaworn, C, Farrar, J, and Puthavathana, P. (2010). Influenza A viral loads in respiratory samples collected from patients infected with pandemic H1N1, seasonal H1N1 and H3N2 viruses. Virol. J. 7, 75.

Ngo, N, Cubitt, B, Iwasaki, M, and de la Torre, J. C. (2015). Identification and Mechanism of Action of a Novel Small-Molecule Inhibitor of Arenavirus Multiplication. J. Virol. 89, 10924-10933.

Park, D. J., Dudas, G, Wohl, S, Goba, A, Whitmer, S. L. M., Andersen, K. G., Sealfon, R. S., Ladner, J. T., Kugelman, J. R., Matranga, C. B., et al. (2015). Ebola Virus Epidemiology, Transmission, and Evolution during Seven Months in Sierra Leone. Cell 161, 1516-1526.

Sanjuan, R, Nebot, M. R., Chirico, N, Mansky, L. M., and Belshaw, R. (2010). Viral Mutation Rates. J. Virol. 84, 9733-9748.

Stoppani, E, Bassi, I, Dotti, S, Lizier, M, Ferrari, M, and Lucchini, F. (2015). Expression of a single siRNA against a conserved region of N P gene strongly inhibits in vitro replication of different Influenza A virus strains of avian and swine origin. Antiviral Res. 120, 16-22.

Sullivan, B. M., Emonet, S. F., Welch, M. J., Lee, A. M., Campbell, K. P., de la Torre, J. C., and Oldstone, M. B. (2011). Point mutation in the glycoprotein of lymphocytic choriomeningitis virus is necessary for receptor binding, dendritic cell infection, and long-term persistence. Proc. Natl. Acad. Sci. U.S.A 108, 2969-2974.

Wang, R, Zhang, Y.-Y., Lu, J.-S., Xia, B.-H., Yang, Z.-X., Zhu, X.-D., Zhou, X.-W., and Huang, P.-T. (2017). The highly pathogenic H5N1 influenza A virus down-regulated several cellular MicroRNAs which target viral genome. J. Cell. Mol. Med.

Wang, S, Chen, C, Yang, Z, Chi, X, Zhang, J, and Chen, J.-L. (2016). Targeted disruption of influenza A virus hemagglutinin in genetically modified mice reduces viral replication and improves disease outcome. Sci. Rep. 6, 23746.

Xu, F, Zhou, Y, Liu, Q, and Liu, G. (2015). RNA interference of influenza A virus replication by microRNA-adapted lentiviral loop short hairpin RNA. J. Gen. Virol. 96, 2971-2981.

Yang, E, van Nimwegen, E, Zavolan, M, Rajewsky, N, Schroeder, M, Magnasco, M, and Darnell, J. E., Jr (2003). Decay rates of human mRNAs: correlation with functional characteristics and sequence attributes. Genome Res. 13, 1863-1872.

Example 10—Improved Cas13a/C2c2 Diagnostics for Viral Diarrheal Illness

Diarrheal diseases are responsible for over half a million deaths each year, the majority in children in the developing world (Walker C L, Rudan I, Liu L, et al. Global burden of childhood pneumonia and diarrhea. Lancet 2013; 381:1405-16). Of these diseases, rotavirus is the leading cause of mortality, and other viruses like norovirus cause severe outbreaks around the world. These infections often go undiagnosed or are misdiagnosed as bacteria leading to inappropriate treatment with antibiotics, worsening patient symptoms and promoting antibiotic resistance. To address this dire public health challenge, a rapid, inexpensive, and sensitive test is greatly needed for the diagnosis of viral diarrheal disease.

Applicants can use the recently discovered RNA guided, RNA-targeting nuclease Cas13a/C2c2 to create diarrheal illness diagnostics. Diagnostics are a crucial first step to treating patients, as they allow doctors to distinguish between bacterial and viral infections, thereby influencing treatment regimens. The CRISPR-Dx platform, termed SHERLOCK (Specific High Sensitivity Enzymatic Reporter UnLOCKing), is a sensitive and specific tool for nucleic acid detection that is cold chain independent and portable.

Using viral diarrheal illnesses as a model, Applicants can create a rapid, field-applicable diagnostic method based on the SHERLOCK technology. In many clinical settings, it takes over 48 hours to diagnosis viral diseases—if a diagnosis is even possible. With a few key technical enhancements on SHERLOCK, including shortening the total assay time to one hour and moving from a fluorescence-based readout to a colorimetric output, Applicants can create a test that can be run using a simple heat block and analyzed visually by a clinical worker. This will circumvent the need for samples to be shipped to a centralized testing lab, which is expensive, time-consuming, and can result in sample degradation. Such delays are especially critical during local or seasonal disease outbreaks, where rapid public health responses can prevent the further spread of an emerging infectious agent.

There are roughly 22 known virus families that infect humans and cause disease, and this number is increasing due to continued population expansion (Woolhouse ME, Howey R, Gaunt E, Reilly L, Chase-Topping M, Savill N. Temporal trends in the discovery of human viruses. Proc Biol Sci 2008; 275:2111-5). Many of these diseases lack adequate diagnostics, the crucial first step to patient treatment. Current gold standard diagnostics like RT-qPCR and ELISA require specialized equipment, a cold chain, are time-consuming, and have a high overhead. Rapid antigen-based diagnostics have proven challenging to develop. Due to these limitations, there is an immense need for rapid, inexpensive, and sensitive diagnostic tools that can be used to detect specific viral pathogens in low-income settings and during outbreaks. Applicants can develop and improve viral diagnostics for diarrheal disease, one of the leading causes of childhood mortality. The new CRISPR-Cas13a/C2c2 system has the ability to quickly recognize and cleave specific RNA sequences derived from DNA or RNA (Abudayyeh O O, Gootenberg J S, Konermann S, et al. C2c2 is a single-component programmable RNA-guided RNA-targeting CRISPR effector. Science 2016; 353:aaf5573), making it an optimal system for viral diagnostics. Moreover, it is particularly suited for outbreaks because new tests can be designed and deployed in a matter of days.

Given SHERLOCK's high sensitivity and successful application to other infectious diseases, this detection platform is an ideal candidate for improving point of care diagnostic and developing a rapid, field deployable and multiplexed test for diarrheal viral pathogens. This approach will improve the diagnosis of severe disease, improve patient care, and decrease the inappropriate use of antibiotics.

One of the major limiting factors of existing diagnostic methods is the lag time between patient examination and laboratory results. For viruses like rotavirus and norovirus, such delays can have deadly effects. By increasing the rate of the Cas13a/C2c2 detection reaction and developing detection protocols that do not require nucleic acid extraction, a "real-time" diagnostic can be achieved. Applicants can have a turnaround time of less than one hour from sample collection to results.

Commonly used nucleic acid detection tests such as RT-qPCR require an extraction prior to amplification due to PCR inhibitors in host material (serum, urine, stools). This is a significant limitation as extractions are time consuming and require a skilled technician. Thus, samples are typically handled in a centralized lab, and are not immediately processed. The isothermal amplification method used by SHERLOCK is not inhibited by host material, allowing for sample preparation protocols to directly amplify from urine and stool for rapid viral detection in the field.

Applicants will optimize the amplification speed via sequence design and by altering the composition of the detection reaction. Previous work has demonstrated that isothermal amplification primers have varying performance, so Applicants will screen at least ten primer pairs to identify those with improved performance. Applicants will optimize guide sequences in a similar fashion, as it has been shown that Cas13a/C2c2 has a preference for cleaving particular sequence motifs. Applicants will also optimize the T7 polymerase concentration, rNTP concentration, background RNA concentration, and magnesium concentration to further enhance the speed of detection. Current iterations of the detection reaction typically take over 2 hours to achieve sensitive nucleic acid detection, but with optimization can be reduced to less than one hour and possibly as low as thirty minutes.

Developing a Colorimetric Readout for Visual Pathogen Detection

One of the biggest limiting factors to clinical diagnostics is the lack of robust infrastructure in many clinical settings worldwide. Current diagnostics often require expensive machines and high-level technical training, while in many clinics basic infrastructure like power is an issue. By moving the current Cas13a/C2c2 detection from a fluorescent output to a visual color-change Applicants can create a user-friendly diagnostic that can be performed by any healthcare worker without requiring an expensive and energy-consuming machine.

Applicants can use two different approaches for colorimetric detection: enzymatic reporters that produce colored products from colorless substrates (e.g., lacZ, peroxidase, beta glucoronidase) and clusters of gold nanoparticles linked by single-stranded RNA that can directly convert nuclease activity into a color change by deaggregating the nanoparticle population and causing a color shift as nanoparticles dissolve into solution. Applicants will carefully evaluate the performance of these two methods, especially as a readout on paper, as they have trade-offs with respect to speed and the ease of determining a color change. The best-performing approach will be tested using clinical samples to further validate its ability to report on the presence of specific nucleic acid sequences.

Developing a Viral Pathogen Multiplex Diagnostic for Diarrheal Illness

Viruses that cause diarrhea including rotavirus, norovirus, Norwalk virus, cytomegalovirus and viral hepatitis often go undiagnosed. These viral infections lead to high mortality and morbidity and are often intensified by medications, such as antibiotics. Applicants can develop a multiplex diagnostic that can determine if a diarrheal infection is viral to help inform patient care, rapidly detect viral outbreaks, and decrease unneeded antibiotic use.

Clinical samples, from stool, urine, and blood, and viral seedstocks will be used to develop SHERLOCK for each pathogen. Applicants will design primer pairs and guides using multiple sequence alignments to account for nucleotide diversity within the binding region. Viral RNA will undergo a recombinase polymerase amplification (RPA) reaction, T7 RNA polymerase will be added to transcribe the amplified DNA to RNA, and Applicants will add the resulting RNA to a new reaction mix consisting of Cas13a and quenched fluorescent reporters and the colorimetric-based system for evaluation.

Example 11—Use of HUDSON Protocol for Viral Detection Directly from Bodily Fluids For SHERLOCK to excel at viral detection in any context, it should be paired with methods enabling direct detection from patient samples with a visual readout. We tested the performance of SHERLOCK for ZIKV and DENV detection on patient samples and developed HUDSON (Heating Unextracted Diagnostic Samples to Obliterate Nucleases), a method to enable rapid, sensitive detection of ZIKV and DENV directly from bodily fluids with a colorimetric readout, recently shown as part of SHERLOCKv2 (Gootenberg et al. Science doi:10.1126/science.aaq0179; 2018). Additionally, we designed SHERLOCK assays to distinguish multiple viral species and strains and identify clinically relevant mutations.

Detection of ZIKV and DENV in patient samples provides a stringent test of the sensitivity of SHERLOCK and its tolerance of viral diversity. Our ZIKV SHERLOCK assay had single-copy (1 cp/µl) sensitivity when tested on seedstock cDNA (FIG. 98). We evaluated its performance on 40 cDNAs derived from samples collected during the 2015-2016 ZIKV pandemic, 37 from patient samples with suspected ZIKV infections and 3 from mosquito pools (FIGS. 87, 99B, and Table 24). For 16 samples from these patients, we benchmarked SHERLOCK by comparing its sensitivity and specificity to other nucleic acid amplification tests including the commercially available Altona Realstar Zika Virus RT-PCR assay (FIGS. 82C, 88A-C, 99C, 100, 101, Table 25, and see Discussion). Of the 10 samples tested positive by the Altona assay, all 10 were detected by SHERLOCK (100% sensitivity); the other 6 samples were negative by both assays (100% specificity, 100% concordance). Our ZIKV assay had no false positives when tested on healthy urine and water (FIG. 99B). We then validated the ability of SHERLOCK to detect DENV, a related but more diverse flavivirus with similar symptoms to ZIKV infection. All 24 RT-PCR-positive DENV RNA samples were confirmed DENV positive after 1 hour of detection (FIGS. 99D, 102, 103, and Table 26). SHERLOCK sensitively and specifically detects viral nucleic acids extracted from ZIKV and DENV patient samples.

TABLE 24

| Sample | Country | Specimen type | Used in | Positive by SHERLOCK | Nucleic Acid Test Performed | Test result |
|---|---|---|---|---|---|---|
| DOM_2016_BB-0054-URI | Dominican Republic | Urine | FIG. 99, FIG. 82, 87, 88, 100 | FALSE | Aptima Zika Virus Assay | 30.77 (S/CO) |

TABLE 24-continued

| Sample | Country | Specimen type | Used in | Positive by SHERLOCK | Nucleic Acid Test Performed | Test result |
|---|---|---|---|---|---|---|
| DOM_2016_BB-0054-SER | Dominican Republic | Serum | FIG. 99, FIG. 100 | * | Aptima Zika Virus Assay | 34.05 (S/CO) |
| DOM_2016_BB-0059-URI | Dominican Republic | Urine | FIG. 99, FIG. 82, 87, 88, 100 | TRUE | Aptima Zika Virus Assay | 33.67 (S/CO) |
| DOM_2016_BB-0059-SER | Dominican Republic | Serum | FIG. 99 FIG. 82, 87, 88, 100 | FALSE | Aptima Zika Virus Assay | 35.07 (S/CO) |
| DOM_2016_BB-0071-SER | Dominican Republic | Serum | FIG. 99, FIG. 82, 87, 88, 100 | TRUE | Aptima Zika Virus Assay | 34.57 (S/CO) |
| DOM_2016_BB-0071-URI | Dominican Republic | Urine | FIG. 99, FIG. 100 | * | Aptima Zika Virus Assay | 0 (S/CO) |
| DOM_2016_BB-0076-SER | Dominican Republic | Serum | FIG. 99, FIG. 82, 87, 88, 100 | TRUE | Aptima Zika Virus Assay | 33.45 (S/CO) |
| DOM_2016_BB-0076-URI | Dominican Republic | Urine | FIG. 99, FIG. 82, 87, 88, 100 | TRUE | Aptima Zika Virus Assay | 36.68 (S/CO) |
| DOM_2016_BB-0085-URI | Dominican Republic | Urine | FIG. 99, FIG. 82, 87, 88, 100 | TRUE | Aptima Zika Virus Assay | 0 (S/CO) |
| DOM_2016_BB-0085-SER | Dominican Republic | Serum | FIG. 99, FIG. 100 | * | Aptima Zika Virus Assay | 33.04 (S/CO) |
| DOM_2016_BB-0091-SER | Dominican Republic | Serum | FIG. 99, FIG. 82, 87, 88, 100 | TRUE | Aptima Zika Virus Assay | 31.8 (S/CO) |
| DOM_2016_BB-0115-SER | Dominican Republic | Serum | FIG. 99, FIG. 112, FIG. 82, 87 88, 100 | TRUE | Aptima Zika Virus Assay | 27.78 (S/CO) |
| DOM_2016_BB-0115-URI | Dominican Republic | Urine | FIG. 99, FIG. 87, 82, 88 | TRUE | None | N/A |
| DOM_2016_BB-0127-SER | Dominican Republic | Serum | FIG. 99, FIG. 82, 87, 88, 100 | TRUE | Aptima Zika Virus Assay | 32.95 (S/CO) |
| DOM_2016_BB-0180-SER | Dominican Republic | Serum | FIG. 99, FIG. 82, 87, 88, 100 | TRUE | Aptima Zika Virus Assay | 31.93 (S/CO) |
| DOM_2016_BB-0180-URI | Dominican Republic | Urine | FIG. 99, FIG. 82, 87, 88, 100 | FALSE | Aptima Zika Virus Assay | 36.8 (S/CO) |
| DOM_2016_BB-0183-SER | Dominican Republic | Serum | FIG. 99, FIG. 82, 87, 88, 100 | TRUE | Aptima Zika Virus Assay | 33.64 (S/CO) |
| DOM_2016_BB-0183-URI | Dominican Republic | Urine | FIG. 99, FIG. 82, 87, 88, 100 | FALSE 88, 100 | Aptima Zika Virus Assay | 0 (S/CO) |
| DOM_2016_BB-0184-URI | Dominican Republic | Urine | FIG. 99, FIG. 87, 82, 88 | TRUE | None | N/A |
| USA_2016_FL-01-MOS | United States | Mosquito Pool | FIG. 82, 87, 88, 100 | TRUE | Faye-E (Faye, O, 2008), gel electrophoresis | * |
| USA_2016_FL-02-MOS | United States | Mosquito Pool | FIG. 112, FIG. 82, 87, 88, 100 | TRUE | Faye-E (Faye, O, 2008), gel electrophoresis | * |
| USA_2016_FL-03-MOS | United States | Mosquito Pool | FIG. 82, 87, 88, 100 | TRUE | Faye-E (Faye, O, 2008), gel electrophoresis | * |
| USA_2016_FL-021-URI | United States | Urine | FIG. 99, FIG. 87, 82, 88 | TRUE | Faye-E (Faye, O, 2008) | Ct 27.57 |
| USA_2016_FL-029-URI | United States | Urine | FIG. 99, FIG. 87, 82, 88 | FALSE | Faye-E (Faye, O, 2008) | Ct 33.6 |
| USA_2016_FL-030-URI | United States | Urine | FIG. 99, FIG. 87, 82, 88 | TRUE | Faye-E (Faye, O, 2008) | Ct 29.27 |
| HND_2016_HU-ME33-PLA | Honduras | Plasma | FIG. 99, FIG. 87, 82, 88 | FALSE | Lanciotti (Lanciotti, R. S. 2008) | Ct 33.35 |
| HND_2016_HU-ME38-PLA | Honduras | Plasma | FIG. 99, FIG. 87, 82, 88 | TRUE | Lanciotti (Lanciotti, R. S. 2008) | Ct 29.95 |

TABLE 24-continued

| Sample | Country | Specimen type | Used in | Positive by SHERLOCK | Nucleic Acid Test Performed | Test result |
|---|---|---|---|---|---|---|
| HND_2016_HU-ME42-SER | Honduras | Serum | FIG. 99, FIG. 87, 82, 88 | TRUE | Lanciotti (Lanciotti, R. S. 2008) | Ct 33.45 |
| HND_2016_HU-ME50-PLA | Honduras | Plasma | FIG. 99, FIG. 87, 82, 88 | FALSE | Lanciotti (Lanciotti, R. S. 2008) | Ct 33.45 |
| HND_2016_HU-ME58-PLA | Honduras | Plasma | FIG. 99, FIG. 112, FIG. 87, 82, 88 | TRUE | Lanciotti (Lanciotti, R. S. 2008) | Ct 33.55 |
| HND-2016_HU-ME59-PLA | Honduras | Plasma | FIG. 99, FIG. 87, 82, 88 | TRUE | Lanciotti (Lanciotti, R. S. 2008) | Ct 33.6 |
| HND_2016_HU-ME131-PLA | Honduras | Plasma | FIG. 99, FIG. 87, 82, 88 | TRUE | Lanciotti (Lanciotti, R. S. 2008) | Ct 34.15 |
| HND_2016_HU-ME136-PLA | Honduras | Plasma | FIG. 99, FIG. 87, 82, 88 | FALSE | Lanciotti (Lanciotti, R. S. 2008) | Ct 35.1 |
| HND_2016_HU-ME137-PLA | Honduras | Plasma | FIG. 99, FIG. 83, 87, 88, 100 | FALSE | Lanciotti (Lanciotti, R. S. 2008) | Ct 35.3 |
| HND-2016_HU-ME147-SER | Honduras | Serum | FIG. 99, FIG. 87, 82, 88 | TRUE | Lanciotti (Lanciotti, R. S. 2008) | Ct 34.15 |
| HND_2016_HU-ME152-SER | Honduras | Serum | FIG. 99, FIG. 87, 82, 88 | TRUE | Lanciotti (Lanciotti, R. S. 2008) | Ct 33.9 |
| HND_2016_HU-ME156-SER | Honduras | Serum | FIG. 99, FIG. 87, 82, 88 | TRUE | Lanciotti (Lanciotti, R. S. 2008) | Ct 34.15 |
| HND_2016_HU-ME167-PLA | Honduras | Plasma | FIG. 99, FIG. 87, 82, 88 | TRUE | Lanciotti (Lanciotti, R. S. 2008) | Ct 32.9 |
| HND-2016_HU-ME171-PLA | Honduras | Plasma | FIG. 99, FIG. 87, 82, 88 | TRUE | Lanciotti (Lanciotti, R. S. 2008) | Ct 34.85 |
| HND_2016_HU-ME172-PLA | Honduras | Plasma | FIG. 99, FIG. 87, 82, 88 | FALSE | Lanciotti (Lanciotti, R. S. 2008) | Ct 34.25 |
| HND_2016_HU-ME178-PLA | Honduras | Plasma | FIG. 99, FIG. 87, 82, 88 | TRUE | Lanciotti (Lanciotti, R. S. 2008) | Ct 34.35 |
| HND_2016_HU-ME180-PLA | Honduras | Plasma | FIG. 99, FIG. 87, 82, 88 | FALSE | Lanciotti (Lanciotti, R. S. 2008) | Ct 33.25 |
| HND_2016_HU-SZ76-SER | Honduras | Serum | FIG. 99, FIG. 87, 82, 88 | FALSE | Lanciotti (Lanciotti, R. S. 2008) | Ct 25.55 |

TABLE 25

| Sample | Country | Specimen type | SHERLOCK flourescence @3 h (mean) | SHERLOCK flourescence @ 3 h (SD) | Positive by Hologic | Positive by Altona |
|---|---|---|---|---|---|---|
| DOM_2016_BB-0054-URI | Dominican Republic | Urine | 40.3333333 | 23.11565126 | TRUE | FALSE |
| DOM_2016_BB-0054-SER | Dominican Republic | Serum | 91.6666667 | 65.49300217 | TRUE | FALSE |
| DOM_2016_BB-0059-URI | Dominican Republic | Urine | 114 | 70.4485628 | TRUE | FALSE |
| DOM_2016_BB-0059-SER | Dominican Republic | Serum | 57987.6667 | 1704.081082 | TRUE | TRUE |
| DOM_2016_BB-0071-SER | Dominican Republic | Serum | 114336 | 1429.226364 | TRUE | TRUE |
| DOM_2016_BB-0071-URI | Dominican Republic | Urine | 58 | 46.13025038 | TRUE | FALSE |
| DOM_2016_BB-0076-URI | Dominican Republic | Urine | 75539.3333 | 961.4345185 | TRUE | TRUE |
| DOM_2016_BB-0085-URI | Dominican Republic | Urine | 29.3333333 | 43.01550108 | FALSE | FALSE |

TABLE 25-continued

| Sample | Country | Specimen type | SHERLOCK flourescence @3 h (mean) | SHERLOCK flourescence @ 3 h (SD) | Positive by Hologic | Positive by Altona |
|---|---|---|---|---|---|---|
| DOM_2016_BB-0085-SER | Dominican Republic | Serum | 123215.333 | 14872.59511 | TRUE | TRUE |
| DOM_2016_BB-0091-SER | Dominican Republic | Serum | 112993 | 2131.246349 | TRUE | TRUE |
| DOM_2016_BB-0115-SER | Dominican Republic | Serum | 97830.6667 | 2968.648233 | TRUE | TRUE |
| DOM_2016_BB-0127-SER | Dominican Republic | Serum | 80429.3333 | 6778.087218 | TRUE | TRUE |
| DOM_2016_BB-0180-SER | Dominican Republic | Serum | 85652.6667 | 4965.606341 | TRUE | TRUE |

TABLE 26

| Sample | Country | Specimen type | SHERLOCK flourescence @1 h (mean) | SHERLOCK flourescence @1 h (SD) | Amplicon PCR pool 1 conc. (ng/ul) | Amplicon PCR pool 2 conc. (ng/ul) | Amplicon PCR yield (ng/ul) |
|---|---|---|---|---|---|---|---|
| DOM_2016_BB_0054-URI | Dominican Republic | Urine | 64 | 28.35489 | 0 | 0.3 | 0 |
| DOM_2016_BB_0059-URI | Dominican Republic | Urine | 4042.333 | 124.084 | 0.2 | 0.5 | 0.2 |
| DOM_2016_BB_0059-SER | Dominican Republic | Serum | 88 | 104.6518 | 2.7 | 3.4 | 2.7 |
| DOM_2016_BB_0071-SER | Dominican Republic | Serum | 456 | 103.0146 | 4.5 | 3.4 | 3.4 |
| DOM_2016_BB_0076-SER | Dominican Republic | Serum | 311.6667 | 38.00439 | 2.9 | 2.7 | 2.7 |
| DOM_2016_BB_0076-URI | Dominican Republic | Urine | 3114 | 570.8704 | 1.7 | 0 | 0 |
| DOM_2016_BB_0085-URI | Dominican Republic | Urine | 473.6667 | 50.80682 | 8.1 | 12.3 | 8.1 |
| DOM_2016_BB_0091-SER | Dominican Republic | Serum | 30426.67 | 7086.829 | 17.5 | 19 | 17.5 |
| DOM_2016_BB_0115-SER | Dominican Republic | Serum | 77020 | 16146.71 | 16.4 | 41.8 | 16.4 |
| DOM_2016_BB_0115-URI | Dominican Republic | Urine | 8701.667 | 2008.831 | 4.7 | 8 | 4.7 |
| DOM_2016_BB_0127-SER | Dominican Republic | Serum | 87383 | 923.0596 | 65.6 | 80 | 65.6 |
| DOM_2016_BB_0180-SER | Dominican Republic | Serum | 80265 | 156.9044 | 6.4 | 8.2 | 6.4 |
| DOM_2016_BB_0180-URI | Dominican Republic | Urine | 41.33333 | 49.09515 | 4.5 | 0.1 | 4.5 |
| DOM_2016_BB_0183-SER | Dominican Republic | Serum | 8689 | 912.5004 | 11.9 | 15.7 | 11.9 |
| DOM_2016_BB_0183-URI | Dominican Republic | Urine | 62.66667 | 52.65295 | 0 | 0.1 | 0 |
| DOM_2016_BB_0184-URI | Dominican Republic | Urine | 3065.667 | 157.8618 | 0.3 | 0 | 0 |
| USA_2016_FL-01-MOS | United States | Mosquito Pool | 35490 | 513.0731 | 38.9 | 144 | 58.9 |
| USA_2016_FL-02-MOS | United States | Mosquito Pool | 10314 | 115.1043 | 67.7 | 76.9 | 67.7 |
| USA_2016_FL-03-MOS | United States | Mosquito Pool | 60385.67 | 791.5013 | 69.8 | 87.5 | 69.8 |
| USA_2016_FL-021-URI | United States | Urine | 16201 | 283.1042 | 8 | 10.2 | 8 |
| USA_2016_FL-029-URI | United States | Urine | 119 | 48.6621 | 0.7 | 1.29 | 0.7 |
| USA_2016_FL-030-URI | United States | Urine | 235.6667 | 53.52881 | 7.2 | 10.1 | 7.2 |
| HND_2016_HU-ME33-PLA | Honduras | Plasma | 45 | 57.8619 | 2.7 | 1 | 1 |
| HND_2016_HU-ME38-PLA | Honduras | Plasma | 33957.33 | 687.6717 | 61.9 | 66.8 | 61.9 |
| HND_2016_HU-ME42-SER | Honduras | Serum | 20041.67 | 189.9746 | 28.3 | 38.6 | 28.3 |
| HND_2016_HU-ME50-PLA | Honduras | Plasma | 106.6667 | 23.15887 | 2.4 | 4.8 | 2.4 |
| HND_2016_HU-ME58-PLA | Honduras | Plasma | 12284 | 303.287 | 36.3 | 38.6 | 36.3 |
| HND_2016_HU-ME59-PLA | Honduras | Plasma | 7115 | 167.9196 | 14.2 | 1.7 | 14.2 |
| HND_2016_HU-ME131-PLA | Honduras | Plasma | 8452.333 | 97.72581 | 8.7 | 13.4 | 8.7 |
| HND_2016_HU-ME136-PLA | Honduras | Plasma | 35 | 6 | 1.1 | 3.3 | 1.1 |
| HND_2016_HU-ME137-PLA | Honduras | Plasma | 23.66667 | 23.43786 | 1 | 1.1 | 1 |
| HND_2016_HU-ME147-SER | Honduras | Serum | 4625.667 | 41.501 | 8.6 | 12.4 | 8.6 |
| HND_2016_HU-ME152-SER | Honduras | Serum | 2165 | 50.47772 | 14.7 | 20.7 | 14.7 |
| HND_2016_HU-ME154-SER | Honduras | Serum | 853.3333 | 163.0164 | 8.1 | 6.2 | 6.2 |
| HND_2016_HU-ME167-PLA | Honduras | Plasma | 15552.67 | 2654.519 | 16.7 | 34.1 | 16.7 |
| HND_2016_HU-ME171-PLA | Honduras | Plasma | 4832.667 | 832.8771 | 4.1 | 6.1 | 4.1 |
| HND_2016_HU-ME172-PLA | Honduras | Plasma | 171.3333 | 46.73685 | 1.9 | 2.9 | 1.9 |
| HND_2016_HU-ME178-PLA | Honduras | Plasma | 1108 | 47.0319 | 18.8 | 24.4 | 18.8 |
| HND_2016_HU-ME180-PLA | Honduras | Plasma | 82.66667 | 49.81298 | 6.2 | 4.9 | 4.9 |
| HND_2016_HU-SZ76-SER | Honduras | Serum | 110.3333 | 45.6545 | 0.8 | 0.5 | 0.5 |

Although SHERLOCK excels at detecting extracted nucleic acids, a field-deployable, rapid diagnostic test should not require an extraction step to detect viral nucleic acid in bodily fluids. Many viruses are shed in urine or saliva, including ZIKV and DENV, and sampling is not invasive (Paz-Bailey et al. *N. Engl. J. Med* doi: 10.1056/NEJMoa1613108 (2017); Andries et al. *PLOS Negl. Trop. Dis.* 9, e0004100 (2015)). To detect viral nucleic acid directly from bodily fluids via SHERLOCK, we developed HUDSON, a method to lyse viral particles and inactivate the high levels of RNases found in bodily fluids using heat and chemical reduction (FIGS. 104A and 89) (Weickmann et al. *J. Biol. Chem.* 257:8705-8710 (1982)). HUDSON-treated urine or saliva could be directly added to RPA reactions without dilution or purification (blood products were diluted 1:3 to avoid solidification during heating), without inhibiting subsequent amplification or detection. HUDSON and SHERLOCK enabled sensitive detection of free ZTKV nucleic acid spiked into urine, whole blood, plasma, serum, or saliva (FIGS. 83A, 83B, 90A, 105, and 106). To mimic clinical infection, where viral nucleic acid is encapsulated in infectious particles, we spiked infectious ZIKV particles into bodily fluids. HUDSON combined with SHERLOCK (FIGS. 91 and 107) permitted sensitive detection of ZIKV RNA from infectious particles at 90 aM (45 cp/µl) in whole blood (FIG. 108) or serum (FIG. 104B), 0.9 aM (~1 cp/µl) in saliva (FIG. 104C), and 20 aM (10 cp/µl) in urine. Total turnaround time was <2 h with fluorescent and colorimetric readout (FIGS. 104D and 114). The sensitivity of HUDSON and SHERLOCK is comparable to ZIKV RNA concentrations observed in patient samples, which range from 1-1,000 cp/µl (Faye et al. *J. Clin. Virol.* 43:96-101 (2008); Paz-Bailey et al. *N. Engl. J. Med.* Doi:10.1056/NEJMoa1613108 (2017)). HUDSON, paired with the pan-DENV SHERLOCK assay, detected DENV in whole blood, serum, and saliva (FIGS. 109 and 110). DENV was detected directly from 8 of 8 patient serum samples (FIG. 104E) and 3 of 3 patient saliva samples tested (FIG. 104F), with a total turnaround time<1 hour from saliva despite lower viral titers than in serum (Andries et al. *PLoS Negl. Trop. Dis.* 9, e0004100 (2015)). We directly detected DENV with a colorimetric readout using lateral flow strips (FIG. 104G), showcasing a HUDSON to SHERLOCK pipeline that can detect ZTKV or DENV directly from bodily fluids with minimal equipment.

Because many genetically and antigenically similar flaviviruses co-circulate and have similar symptoms, we developed diagnostic panels to distinguish related viral species and serotypes. We identified conserved regions within ZIKV, DENV, West Nile virus (WNV), and yellow fever virus (YFV) genomes and designed a flavivirus panel with universal-flavivirus RPA primers that can amplify any of the 4 viruses, and species-specific crRNAs (FIG. 84A). This panel detected synthetic ZTKV, DENV, WNV, and YFV DNA targets with <0.22% off-target fluorescence (FIGS. 84B, 92, and see Methods), and identified the presence of all pairwise combinations of these 4 viruses, demonstrating the ability to detect mock co-infections (FIGS. 84B, 84C, and 93). We also designed a panel using DENV-specific RPA primers and serotype-specific crRNAs (FIG. 84D) that could distinguish between DENV serotypes 1-4 with <3.2% off-target fluorescence (FIGS. 84D, 79C, and 94). This low level of off-target fluorescence allows for 100% specificity in differentiating between serotypes, providing an alternative to current serotype identification approaches (Waggoner et al. *J. Clin. Microbiol.* 51:3418-3420 (2013)). The DENV panel confirmed the serotypes of 12 RT-PCR-serotyped patient samples or clinical isolates (FIGS. 84D and 111), and identified 2 clinical isolates with mixed infection, a commonly observed phenomenon (Requena-Castro et al. *Mem. Inst. Oswaldo Cruz.* 112:520-522 (2017)). SHERLOCK can therefore be extended to differentiate between related viruses or serotypes using a single amplification reaction.

SHERLOCK is uniquely poised for field-deployable variant identification, which would allow real-time tracking of microbial threats. Genotyping of single nucleotide polymorphisms (SNPs) typically involves PCR and either fluorescent- or mass spectrometry-based detection, requiring extensive sample processing, expensive equipment, and limiting field-deployability (Kim et al. *Annu. Rev. Biomed. Eng.* 9:289-320 (2007)). SHERLOCK can identify SNPs by placing a synthetic mismatch in the crRNA near the SNP, testing each target with an ancestral-specific and derived-specific crRNA (FIG. 112A) (Gootenberg et al. *Science* 356:438-442 (2017)). We designed diagnostics for 3 region-specific SNPs from the 2015-2016 ZTKV pandemic (FIG. 112B) and identified these SNPs in synthetic targets, a viral seedstock, and cDNA samples from Honduras, the Dominican Republic, and the United States (FIG. 112C-E). These results demonstrate that SHERLOCK can identify SNPs in samples from the ZIKV pandemic and highlight the single-nucleotide specificity of SHERLOCK.

Rapid identification of emerging drug resistance and other clinically relevant mutations for viruses such as ZIKV and HV would have great utility. A ZIKV point mutation in the PrM region (S139N) recently associated with fetal microcephaly was used as a test case for the rapid development of assays for variant identification (Yuan et al. *Science* eaam7120 (2017)). Within a week of the report's publication (FIGS. 112F and 113), we developed multiple SHERLOCK assays for the S139N mutation (FIGS. 96 and 112G) and could identify the mutation in patient samples from the 2015-2016 ZIKV pandemic with a visual readout (FIG. 112H). To further illustrate the ease of developing SHERLOCK diagnostics for many clinically relevant mutations, we designed and tested assays for the six most commonly observed drug-resistance mutations in HV reverse transcriptase (Rhee et al. *Nucleic Acids Res.* 31:298-303 (2003)) in 1 week (FIG. 97). These examples underscore that SHERLOCK could be used for monitoring clinically relevant variants in near real time.

Combining HUDSON and SHERLOCK, we have created a field-deployable viral diagnostic platform with high performance and minimal equipment or sample processing requirements. This platform is as sensitive and specific as amplification-based nucleic acid diagnostics (Piepenburg et al. *PLoS Biol.* 4, e204 (2006)); Yu et al. Angew. Chem. Int. EdEngl. 56, 992-996 (2017); Eboigbodin et al. *Diagn. Microbiol. Infect. Dis.* 86:369-371 (2016); Pardee et al. Cell 165:1255-1266 (2016); Chotiwan et al. *Sci. Transl. Med.* 9 (2017) doi:10.1126/scitranslmed.aag0538; Van Ness et al. *PNAS* 100:4504-4509 (2003)), with similar speed and equipment requirements to rapid antigen tests (Bosch et al. *Sci. Transl. Med* 9 (2017), doi:10.1126/scitrtranslmed.aan1589; Balmaseda et al. *PNAS USA* 114:8384-8389 (2017); Priyamvada et al. *PNAS USA* 113:7852-7857 (2016)). Furthermore, this approach can be easily adapted to detect virtually any virus present in bodily fluids, scaled to enable multiplexed detection (Gootenberg et al. *Science* doi:10.1126/science.aaq0179 (2018)), and the reagents can be lyophilized for cold-chain independence (Gootenberg et al. Science 356:438-442 (2017)). Cas13-based detection is a promising next-generation diagnostic strategy with the potential to be implemented almost anywhere in the world to enable effective, rapid diagnosis of viral infections.

Materials and Methods

Clinical Samples/Ethics Statement. Clinical samples used for this study were from clinical studies evaluated and approved by the Institutional Review Boards/Ethics Review Committees at Hospital General de la Plaza de la Salud (Santo Domingo, Dominican Republic), Florida Department of Health (Tallahassee, Florida), and Universidad Nacional Autonoma de Honduras (Tegucigalpa, Honduras). Massachusetts Institute of Technology (MIT) Institutional Review Board/Ethics Review Committee and the Office of Research Subject Projection at the Broad Institute provided approval for use of samples collected by the previously listed institutions. For the dengue virus clinical samples, The Broad Institute Institutional Review Board/Ethics Review Committee provided approval for the use of the samples.

Zika virus (ZIKV) clinical samples were collected during the 2015-2016 Zika pandemic and tested at collaborating sites with either the Hologic Aptima ZIKV assay or published ZIKV RT-PCR or RT-qPCR assays depending on the collaborating site. The nucleic acid testing and results are reported in Table 24. Extracted RNA from these collected clinical samples were prepared for metagenomic and targeted sequencing and genomes published previously (Metsky et al. Nature 546:411-415 (2017)) and cDNA from these 40 preparations were used as input for comparing SHERLOCK and to amplicon PCR performance. Extracted RNA from 16 of these samples were also tested using the Altona RealStar Zika virus RT-PCR kit, details of the assay are found below, and the samples tested and their results are reported in Table 25.

Confirmed positive dengue virus (DENV) patient serum samples were excess from the comparative genomics of DENV for the Broad Institute Viral Genomics Initiative. In addition, four confirmed DENV positive patient serum samples and three matched saliva samples were obtained from Boca Biolistics. Extracted RNA from DENV RT-PCR positive human serum samples, and clinical isolates were excess from the comparative genomics of DENV for the Broad Institute Viral Genomics Initiative. Clinical isolates were prepared by culturing human serum on C6/36 cells and harvesting RNA from the cell supernatant with the RNA extraction protocol outlined below.

Production of LwCas13a and crRNAs. LwCas13a was purified as described in-house (Gootenberg et al. Science 356:438-442 (2017)) or by Genscript. crRNA DNA templates were annealed to a T7 promoter oligonucleotide at a final concentration of 10 µM in 1× Taq reaction buffer (NEB). This involved 5 minutes of denaturation at 95° C. followed by an anneal at 5° C. per minute down to 4° C. crRNAs were transcribed in vitro using the HiScribe T7 High Yield RNA Synthesis Kit (NEB). Transcriptions were performed according to the manufacturer's instructions for short RNA transcripts, with the volume scaled to 30 µl. Reactions were incubated overnight at 37° C. Transcripts were purified using RNAClean XP beads (Beckman Coulter) with a 2× ratio of beads to reaction volume and an additional supplementation of 1.8× isopropanol. Some crRNAs were synthesized by Integrated DNA Technologies (IDT).

Sample Preparation. Viral RNA was extracted from 140 µl of input material using the QIAamp Viral RNA Mini Kit (QIAGEN) with carrier RNA according to the manufacturer's instructions. Samples were eluted in 60 µl of nuclease free water and stored at −80° C. until use.

To produce cDNA, 5 µl of extracted RNA was converted into single-stranded cDNA using methods published previously (Matranga et al. Genome Biol. 15:519 (2014)). In short, RNA was reverse transcribed with SuperScript III (Invitrogen) and random hexamer primers. RNA-DNA duplexes were then degraded with RNase H. cDNA was stored at −20° C. until use. In some experiments (FIGS. 99C and 100), reverse transcription was performed using SuperScript IV for 20 minutes at 55° C., without RNase H treatment.

A single cultured isolate, ZIKV Pernambuco (isolate PE243, KX197192.1), was used as a positive control or as a control for the ancestral sequence in ZIKV detection experiments. Viral RNA was extracted from 140 µl of the seed stock sample using the RNA extraction method described above.

RNase inactivation of urine samples was performed by addition of TCEP/EDTA and heating samples. TCEP and EDTA were added to urine samples at final concentrations of 100 mM and 1 mM respectively. Two protocols were used: 1-step inactivation at 95° C. for 10 minutes, or 2-step inactivation at 50° C. for 20 minutes followed by 95° C. for 5 minutes. Inactivations were performed using a thermocycler or a dry heat block.

RNase inactivation of Zika virus in whole blood, plasma, serum, and saliva samples was performed by addition of TCEP/EDTA and heating samples. TCEP and EDTA were added to urine samples at final concentrations of 100 mM and 1 mM respectively. A 2-step inactivation at 50° C. for 5 minutes followed by 64° C. for 5 minutes (blood products or saliva), or 50° C. for 20 minutes followed by 95° C. for 5 minutes (urine) was used. Inactivations were performed using a thermocycler or a dry heat block.

RNase inactivation of DENV in whole blood, serum, and saliva samples was performed by addition of TCEP/EDTA and heating samples. TCEP and EDTA were added to urine samples at final concentrations of 100 mM and 1 mM respectively. A 2-step inactivation at 42° C. (or in some experiments, 37° C.) for 20 minutes followed by 64° C. for 5 minutes was used. Inactivations were performed using a thermocycler.

RPA Reactions and Primer Design. For RPA reactions, the Twist-Dx RT-RPA kit was used according to the manufacturer's instructions. Primer concentrations were 480 nM. For amplification reactions involving RNA, Murine RNase inhibitor (NEB M3014L) was used at a final concentration of 2 units per microliter. All RPA reactions were 20 minutes unless otherwise stated.

For ZIKV detection, RPA primers RP819/RP821 from a recent publication were used (Gootenberg et al. Science 356:438-442 (2017)). For pan-DENV detection, irrespective of serotype, an equal mix of published RPA primers DENV1-3-RPA-RP4/DENV1-3-RPA-FP13 and DENV4-RPA-RP2/DENV4-RPA-FP3 were used (Abd El Wahed et al. PLoS One 10, e0129682 (2015)). For the flavivirus panel, RPA primers FLAVI-NS5fwd-1/FLAVI-NS5rev-1 were used. For the DENV panel to differentiate between serotypes, RPA primers DENV-3UTRfwd-1/DENV-3UTRrev-1 were used. For region-specific Zika SNP detection, RPA primers DOMUSA-5249-fwd/DOMUSA-5249-rev (DOMUSA5249 SNP), USA-935-fwd/USA-935-rev (USA935 SNP), and HND-2788-fwd/HND-2788-rev (HND2788 SNP) were used. For detecting a Zika SNP associated with microcephaly, RPA primers ZIKV-mcep-fwd and ZIKV-mcep-rev were used. For detecting drug-resistance SNPs in HIV reverse transcriptase, RPA primers HIVRT-149F/HIVRT-348R (K65R, K103N, and V106M SNPs), and HIV- 462F/HIVRT-601R (Y181C, M184V, and G190A SNPs) were used. For a complete list of RPA primer names and sequences, see Table 28.

TABLE 27

Metadata for DENV Patient Samples and Clinical Isolates. We show a variety of information for the 24 DENV RNA samples, 8 serum patient samples, 3 saliva samples including country of origin, sample type, and Figs. used in are shown.

| Sample | Country | Specimen type | Used in |
|---|---|---|---|
| 2207_SER | Columbia | RNA (serum) | FIG. 99, FIG. 84, FIG. 103, 111 |
| 3736_SER | Columbia | RNA (serum) | FIG. 99, FIG. 103 |
| 3739_SER | Columbia | RNA (serum) | FIG. 99, FIG. 103 |
| 3742_SER | Columbia | RNA (serum) | FIG. 99, FIG. 103 |
| 3745_SER | Columbia | RNA (serum) | FIG. 99, FIG. 103 |
| 3754_SER | Columbia | RNA (serum) | FIG. 99, FIG. 103 |
| 3764_SER | Columbia | RNA (serum) | FIG. 99, FIG. 103 |
| 3766_SER | Columbia | RNA (serum) | FIG. 99, FIG. 103 |
| 2280_SER | Columbia | RNA (serum) | FIG. 99, FIG. 103 |
| 148_ISO | Columbia | RNA (clinical isolate) | FIG. 99, FIG. 84, FIG. 103, FIG. 111 |
| 141_ISO | Columbia | RNA (clinical isolate) | FIG. 99, FIG. 84, FIG. 103, FIG. 111 |
| 142_ISO | Columbia | RNA (clinical isolate) | FIG. 99, FIG. 103 |
| 16646_ISO | Mexico | RNA (clinical isolate) | FIG. 99, FIG. 84, FIG. 103, FIG. 111 |
| 18565_ISO | Mexico | RNA (clinical isolate) | FIG. 99, FIG. 103 |
| 18574_ISO | Mexico | RNA (clinical isolate) | FIG. 99, FIG. 84, FIG. 103, FIG. 111 |
| 18719_ISO | Mexico | RNA (clinical isolate) | FIG. 99, FIG. 84, FIG. 103, FIG. 111 |
| 18720_ISO | Mexico | RNA (clinical isolate) | FIG. 99, FIG. 84, FIG. 103, FIG. 111 |
| 20593_ISO | Mexico | RNA (clinical isolate) | FIG. 99, FIG. 103 |
| 20697_ISO | Mexico | RNA (clinical isolate) | FIG. 99, FIG. 84, FIG. 103, FIG. 111 |
| P1_SER | Peru | RNA (serum) | FIG. 99, FIG. 84, FIG. 103, FIG. 111 |
| P2_SER | Peru | RNA (serum) | FIG. 99, FIG. 84, FIG. 103, FIG. 111 |
| P7_SER | Peru | RNA (serum) | FIG. 99, FIG. 84, FIG. 103, FIG. 111 |
| P155_SER | Peru | RNA (serum) | FIG. 99, FIG. 84, FIG. 103, FIG. 111 |
| P164_SER | Peru | RNA (serum) | FIG. 99, FIG. 103 |
| BB_20544_SER | Peru | Serum | FIG. 104 |
| BB_20545_SER | Peru | Serum | FIG. 104 |
| BB_20547_SER | Peru | Serum | FIG. 104 |
| BB_20553_SER | Peru | Serum | FIG. 104 |
| BB_20545_SAL | Peru | Saliva | FIG. 104 |
| BB_20547_SAL | Peru | Saliva | FIG. 104 |
| BB_20553_SAL | Peru | Saliva | FIG. 104 |
| RPDen06/74 | Brazil | Serum | FIG. 104 |
| VDen06/27 | Brazil | Serum | FIG. 104 |
| RPDen05/31 | Brazil | Serum | FIG. 104 |
| RPDen08/293 | Brazil | Serum | FIG. 104 |

TABLE 28

List of RPA primer sequences used in this study. Forward primers contain the T7 promoter sequence primer gaaatTAATACGACTCACTATAggg (SEQ ID NO: 924) at their 5' end.

| primer | | | |
|---|---|---|---|
| RP819 | FIG. 99, FIG. 104, FIGS. 87, 98, 100, FIGS. 83, 105, 106, FIG. 108, FIG. 114 | gaaatTAATACGACTCACTATAGGGCGTGGCGCACTAC ATGTACT (SEQ. ID NO: 925) | Gootenberg et al. 2017 |
| RP821 | FIG. 99, FIG. 104, FIGS. 87, 98, 100, FIGS. 83, 105, 106, FIG. 108, FIG. 114 | TGTCAATGTCAGTCACCACTATTCCATCCA (SEQ. ID NO: 926) | Gootenberg et al. 2017 |
| DENV1-3-RPA-RP4 | FIG. 99, FIG. 104, FIG. 102 FIG. S7, FIG. S18 | gaaatTAATACGACTCACTATAgggAACAGCATATTGA CGCTGGGAGAGACCAGAGATC (SEQ. ID. NO: 927) | Abd El Wahed, A. et. al. 2015 |

TABLE 28-continued

List of RPA primer sequences used in this study.
Forward primers contain the T7 promoter sequence
primer gaaatTAATACGACTCACTATAggg (SEQ ID NO: 924) at their 5' end.

| | | | |
|---|---|---|---|
| DENV1-3-RPA-FP13 | FIG. 99, FIG. 104, FIG. 102, FIG. S7, FIG. S18 | ATTCAACAGCACCATTCCATTTTCTGGCGTTCTGTG (SEQ. ID NO: 928) | Abd El Wahed, A. et. al. 2015 |
| DENV4-RPA-RP2 | FIG. 99, FIG. 104, FIG. 102, FIG. S7, FIG. S18 | gaaatTAATACGACTCACTATAgggCACAAAAACAGCATATTGACGCTGGGAAAG (SEQ. ID NO: 929) | Abd El Wahed, A. et. al. 2015 |
| DENV4-RPA-FP3 | FIG. 99, FIG. 104, FIG. 102, FIG. 103, FIG. 110 | CATCTTGCGGCGCTCTGTGCCTGGATTGA (SEQ. ID NO: 930) | Abd El Wahed, A. et. al. 2015 |
| FLAVI-NS5fwd-1 | FIG. 84, FIGS. 84, 92, 93 | gaaatTAATACGACTCACTATAGGGGTACAACATGATGGGGAARAGAGARAARAA (SEQ. ID NO: 931) | This study |
| FLAVI-NS5rev-1 | FIG. 84, FIGS. 84, 92, 93 | CGKGTGTCCCAGCCNGCKGTGTCATCWGCA (SEQ. ID NO: 932) | This study |
| DENV-3UTRfwd-1 | FIG. 84 FIGS. 79, 94, 111 | gaaatTAATACGACTCACTATAGGGTTGAGCAAACCGTGCTGCCTGTAGCTCC (SEQ. ID NO: 933) | This study |
| DENV-3UTRrev-1 | FIG. 84, FIGS. 79, 94, 111 | GGGAGGGGTCTCCTCTAACCRCTAGTC (SEQ. ID NO: 934) | This study |
| DOMUSA-5249-fwd | FIG. 112 | gaaatTAATACGACTCACTATAGGGACTGTCTTAGACTTGCATCCTGGAGCTGGG (SEQ. ID NO: 935) | This study |
| DOMUSA-5249-rev | FIG. 112 | CTTCCTCCATTTCAGCAGCGACAACCCTGG (SEQ. ID NO: 936) | This study |
| USA-935-fwd | FIG. 112 | gaaatTAATACGACTCACTATAGGGTAGAGTCGAAAATTGGATATTCAGGAACCC (SEQ. ID NO: 937) | This study |
| USA-935-rev | FIG. 112 | AACCCAAGTCCCACCTGACATACCTTCCAC (SEQ. ID NO: 938) | This study |
| HND-2788-fwd | FIG. 112 | gaaatTAATACGACTCACTATAGGGTGGAAGAGAATGGAGTTCAACTGACGGTCG (SEQ. ID NO: 939) | This study |
| HND-2788-rev | FIG. 112 | GAAGTGCGATTTCCCCCAAGCCTTCCAGCC (SEQ. ID NO: 940) | This study |
| ZIKV-mcep-fwd | FIG. 112, FIG. 96 | gaaatTAATACGACTCACTATAGGGTACTAGTGTCGGAATTGTTG (SEQ. ID NO: 941) | This study |
| ZIKV-mcep-rev | FIG. 112 FIG. 96 | TAACACTTATTCATCCCCAATGTGGTTG (SEQ. ID NO: 942) | This study |
| HIVRT-149F | FIG. 97 | gaaatTAATACGACTCACTATAgggTTGGGCCTGAAAATCCATACAATACTCCAG (SEQ. ID NO: 943) | This study |
| HIVRT-348R | FIG. 97 | AAAATATGCATCACCCACATCCAGTACTG (SEQ. ID NO: 944) | This study |
| HIVRT-462F | FIG. 97 | gaaatTAATACGACTCACTATAgggAGGATCACCAGCAATATTCCAAAGTAGCATG (SEQ. ID NO: 945) | This study |
| HIVRT-601R | FIG. 97 | TTGTTCTATGCTGCCCTATTTCTAAGTCAG (SEQ. ID NO: 946) | This study |

Cas13 Detection Reactions and crRNA Design. Detection reactions were performed as described (Gootenberg et al. Science 356:438-442 (2017)), except that background RNA input per reaction was reduced from 100 to 0-25 ng. This increases the reaction rate without introducing any spurious cleavage of the reporter oligonucleotide. Unless indicated otherwise, RNase Alert v2 (Thermo) was used as the reporter. Biotek microplate readers (Synergy H4, Neo2, and Cytation 5) were used for measuring fluorescence of the detection reaction. Fluorescence kinetics were monitored using a monochromator with excitation at 485 nm and emission at 520 nm with a reading every 5 minutes for up to 3 hours. We did not observe significant differences in sensitivity between the different machines; machines were thus utilized interchangeably. Fluorescence values reported were background subtracted or template-specific values. Time point reported is noted in the figure captions.

For ZIKV detection, the crRNA "Zika targeting crRNA 2" from a recent publication was used (Gootenberg et al. Science 356:438-442 (2017)). For pan-DENV detection irrespective of serotype, an equal mix of 3 crRNAs and D1-3UTRat10660, D2/3-3UTrat10635, D4-3UTRat10620 were used. For the flavivirus panel, crRNAs ZIKV-NS5at9227 (ZIKV), DENV-NS5at9127 (DENV), WNV-NS5at9243 (WNV), and YFV-NS5at9122 (YFV) were used. For the DENV panel to differentiate between serotypes, crRNAs D1-3UTRat10457 (DENV1), D2-3UTRat10433 (DENV2), D3-3UTRat10419 (DENV3), and D4-3UTRat10366 (DENV4) were used. For region-specific Zika SNP detection, crRNAs DOMUSA-5249-ancestral/DOMUSA-5249-derived (DOMUSA5249 SNP), USA-935-ancestral/USA-935-derived (USA935 SNP), and HND-2788-ancestral/HND-2788-derived (HND2788 SNP) were used. For detecting a Zika SNP associated with microcephaly, crRNAs ZIKV-mcep-snp3 syn5-ancestral/ZKV-mcep-snp3syn5-derived (design shown in FIG. 112F), and crRNAs ZKV-mcep-snp7-ancestral/ZIKV-mcep-snp7-derived (design shown in FIG. 105) were used. For detecting drug-resistance SNPs in HIV reverse transcriptase, crRNAs HIVRT-K65R-ancestral/HIVRT-K65R-derived (K65R SNP), HVRT-K103N-ancestral/HIVRT-K103N-derived (K 103N SNP), H1VRT-V016M-ancestral/HVRT-V 106M-derived (V06M SNP), HIVRT-Y181C-ancestral/HIVRT-Y181C-derived (Y181C SNP), HIVRT-M184V-ancestral/HIVRT-M184V-derived (Ml84V SNP), and HIVRT-G190A-ancestral/HIVRT-G190A-derived (G190A SNP) were used. For a complete list of crRNA names and spacer sequences, see Table 29. For additional discussion of the effect of crRNA sequence and secondary structure on activity, see the Discussion.

TABLE 29

List of crRNA spacer sequences used in this study. All crRNAs used in this study contain the same direct repeat sequence (GAUUUAGACUACCCCAAAAACGAAGGGGACUAAAAC (SEQ ID NO: 947)). A 5' GGG for increased yield during T7 in vitro transcription is encoded in the T7 promoter sequence primer (gaaatTAATACGACTCACTATAggg (SEQ ID NO: 948)).

| crRNA Name | Used in | Spacer Sequence | Reference |
|---|---|---|---|
| Zika targeting crRNA 2 | FIG. 99, FIG. 104, FIG. 87, 98, 100, FIG. 83, 105, 106, FIG. 108, FIG. 114 | (SEQ ID NO: 949) | Gootenberg et al. 2017 |
| D1-3UTRat10660 | FIG. 99, FIG. 104, FIG. 102, FIG. 103, FIG. 110 | (SEQ ID NO: 950) | This study |
| D2/3-3UTRat10635 | FIG. 99, FIG. 104, FIG. 102, FIG. 103, FIG. 110 | (SEQ ID NO: 951) | This study |
| D4-3UTRat10620 | FIG. 99, FIG. 104, FIG. 102, FIG. 103, FIG. 110 | (SEQ ID NO: 952) | This study |
| ZIKV-NS5at9227 | FIG. 84, FIG. 84, 92, 93 | (SEQ ID NO: 953) | This study |
| DENV-NS5at9127 | FIG. 84, FIG. 84, 92, 93 | (SEQ ID NO: 954) | This study |
| WNV-NS5at9243 | FIG. 84, FIG. 84, 92, 93 | (SEQ ID NO: 955) | This study |
| YFV-NS5at9122 | FIG. 84, FIG. 84, 92, 93 | (SEQ ID NO: 956) | This study |
| D1-3UTRat10457 | FIG. 84, FIG. 79, 94, 111 | (SEQ ID NO: 957) | This study |
| D2-3UTRat10433 | FIG. 84, FIG. 79, 94, 111 | (SEQ ID NO: 958) | This study |
| D3-3UTRat10419 | FIG. 84, FIG. 79, 94, 111 | (SEQ ID NO: 959) | This study |
| D4-3UTRat10366 | FIG. 84, FIG. 79, 94, 111 | (SEQ ID NO: 960) | This study |
| DOMUSA-5249-ancestral | FIG. 112 | (SEQ ID NO: 961) | This study |
| DOMUSA-5249-derived | FIG. 112 | (SEQ ID NO: 962) | This study |
| USA-935-ancestral | FIG. 112 | (SEQ ID NO: 963) | This study |
| USA-935-derived | FIG. 112 | (SEQ ID NO: 964) | This study |
| HND-2788-ancestral | FIG. 112 | (SEQ ID NO: 965) | This study |
| HND-2788-derived | FIG. 112 | (SEQ ID NO: 966) | This study |
| ZIKV-mcep-snp3syn5-derived | FIG. 112, FIG. 96 | (SEQ ID NO: 967) | This study |
| ZIKV-mcep-snp3syn5-ancestral | FIG. 112, FIG. 96 | (SEQ ID NO: 968) | This study |
| ZIKV-mcep-snp7-ancestral | FIG. 112, FIG. 96 | (SEQ ID NO: 969) | This study |
| ZIKV-mcep-snp7-derived | FIG. 112, FIG. 96 | (SEQ ID NO: 970) | This study |
| HIVRT-K65R-ancestral | FIG. 97 | (SEQ ID NO: 971) | This study |
| HIVRT-K65R-derived | FIG. 97 | (SEQ ID NO: 972) | This study |
| HIVRT-K103N-ancestral | FIG. 97 | (SEQ ID NO: 973) | This study |
| HIVRT-K103N-derived | FIG. 97 | (SEQ ID NO: 974) | This study |
| HIVRT-V106M-ancestral | FIG. 97 | (SEQ ID NO: 975) | This study |
| HIVRT-V106M-derived | FIG. 97 | (SEQ ID NO: 976) | This study |
| HIVRT-Y181C-ancestral | FIG. 97 | (SEQ ID NO: 977) | This study |
| HIVRT-Y181C-derived | FIG. 97 | (SEQ ID NO: 978) | This study |
| HIVRT-M184V-ancestral | FIG. 97 | (SEQ ID NO: 979) | This study |
| HIVRT-M184V-derived | FIG. 97 | (SEQ ID NO: 980) | This study |

TABLE 29-continued

List of crRNA spacer sequences used in this study. All crRNAs used in this study contain the same direct repeat sequence (GAUUUAGACUACCCCAAAAACGAAGGGGACUAAAAC (SEQ ID NO: 947)). A 5' GGG for increased yield during T7 in vitro transcription is encoded in the T7 promoter sequence primer (gaaatTAATACGACTCACTATAggg (SEQ ID NO: 948)).

| crRNA Name | Used in | Spacer Sequence | Reference |
|---|---|---|---|
| HIVRT-G190A-ancestral | FIG. 97 | (SEQ ID NO: 981) | This study |
| HIVRT-G190A-derived | FIG. 97 | (SEQ ID NO: 982) | This study |

Lateral Flow Detection Reactions. Lateral flow detection was achieved using a custom probe oligonucleotide (LF-polyU, see Table 30 for the sequence) with commercially available detection strips (Milenia Hybridetect 1, TwstDx, Cambridge, UK). Cas13 detection reactions were diluted 1:5 in Hybridetect Assay Buffer, then the strips were inserted and incubated for 5 minutes at room temperature. The strips were then removed and photographed using a smartphone camera.

TABLE 30

List of synthetic target sequences and RNA reporters used in this study. All synthetic targets were ordered as gBlocks from IDT, and contain the 25 nucleotide T7 promoter sequence primer sequence (gaaatTAATACGACTCACTATAggg (SEQ ID NO: 983)) at their 5' end. This allows for in vitro transcription of the gBlock, either before or after RPA amplification. Fluorescent reporters were ordered as HPLC-purified RNA oligonucleotides from IDT.

| Name | Used in | Sequence | Reference |
|---|---|---|---|
| ZIKV_strt8924 | FIG. 84, FIGS. 84, 92, 93 | (SEQ. ID NO: 984) | This study |
| DENV_strt8284 | FIG. 84, FIGS. 84, 92, 93 | (SEQ. ID NO: 985) | This study |
| WNV_strt8940 | FIG. 84, FIGS. 84, 92, 93 | (SEQ. ID NO: 986) | This study |
| YFV_strt8897 | FIG. 84, FIGS. 84, 92, 93 | (SEQ. ID NO: 987) | This study |
| DENV1_strt10264 | FIG. 84, FIGS. 79, 94, 111 | (SEQ. ID NO: 988) | This study |
| DENV2_strt10251 | FIG. 84 FIGS. 79, 94, 111 | (SEQ. ID NO: 989) | This study |
| DENV3_strt10224 | FIG. 84, FIGS. 79, 94, 111 | (SEQ. ID NO: 990) | This study |
| DENV4_strt10181 | FIG. 84 FIGS. 79, 94, 111 | (SEQ. ID NO: 991) | This study |
| DOMUSA 5249 ancestral target | FIG. 112 | (SEQ. ID NO: 992) | This study |
| DOMUSA 5249 derived target | FIG. 112 | (SEQ. ID NO: 993) | This study |
| USA 935 ancestral target | FIG. 112 | (SEQ. ID NO: 994) | This study |
| USA 935 derived target | FIG. 112 | (SEQ. ID NO: 995) | This study |
| HND 2788 ancestral target | FIG. 112 | (SEQ. ID NO: 996) | This study |
| HND 2788 derived target | FIG. 112 | (SEQ. ID NO: 997) | This study |
| ZIKV mcep ancestral target | FIG. 112, FIG. 96 | (SEQ. ID NO: 998) | This study |
| ZIKV mcep derived target | FIG. 112, FIG. 96 | (SEQ. ID NO: 999) | This study |
| HIVRT aa48-203 ancestral target | FIG. 97 | (SEQ. ID NO: 1000) | This study |
| HIVRT aa48-203 K65R target | FIG. 97 | (SEQ. ID NO: 1001) | This study |
| HIVRT aa48-203 K103N target | FIG. 97 | (SEQ. ID NO: 1002) | This study |
| HIVRT aa48-203 V106M target | FIG. 97 | (SEQ. ID NO: 1003) | This study |
| HIVRT aa48-203 Y181C target | FIG. 97 | (SEQ. ID NO: 1004) | This study |
| HIVRT aa48-203 M184V target | FIG. 97 | (SEQ. ID NO: 1005) | This study |
| HIVRT aa48-203 G190A target | FIG. 97 | (SEQ. ID NO: 1006) | This study |
| LF-polyU | FIG. 104, FIG. 112, FIG. 114 | /56-FAM/ UUUUUUUU UUUUUU/3Bio/ (SEQ. ID NO: 1007) | This study |

RT-PCR Experiments. RT-PCR for ZIKV detection was performed using the Altona Real Star Zika Virus RT-PCR Kit (RUO version) according to the manufacturer's specifications on a Lightcycler 96 RT-PCR machine (Roche). Ten µl of ZTKV RNA extracted from patient samples was used as an input for RT-PCR. One µl of internal control (IC) was used for each sample.

Data Analysis. Background subtraction was performed by subtracting the fluorescence values after 0 minutes (FIGS. 98, 99D, 102, 103), 10 minutes (FIGS. 84, 991B-C, and 104) or 20 minutes (FIG. 112), when minimum fluorescence was observed. For both the flavivirus panel and the DENV panel, background subtracted fluorescence was normalized to target-specific fluorescence. Target specific fluorescence is the mean background subtracted fluorescence of the no input (water) control with a given crRNA subtracted from the background subtracted fluorescence of a given DNA target with the same crRNA at each time point.

Figure 88B:
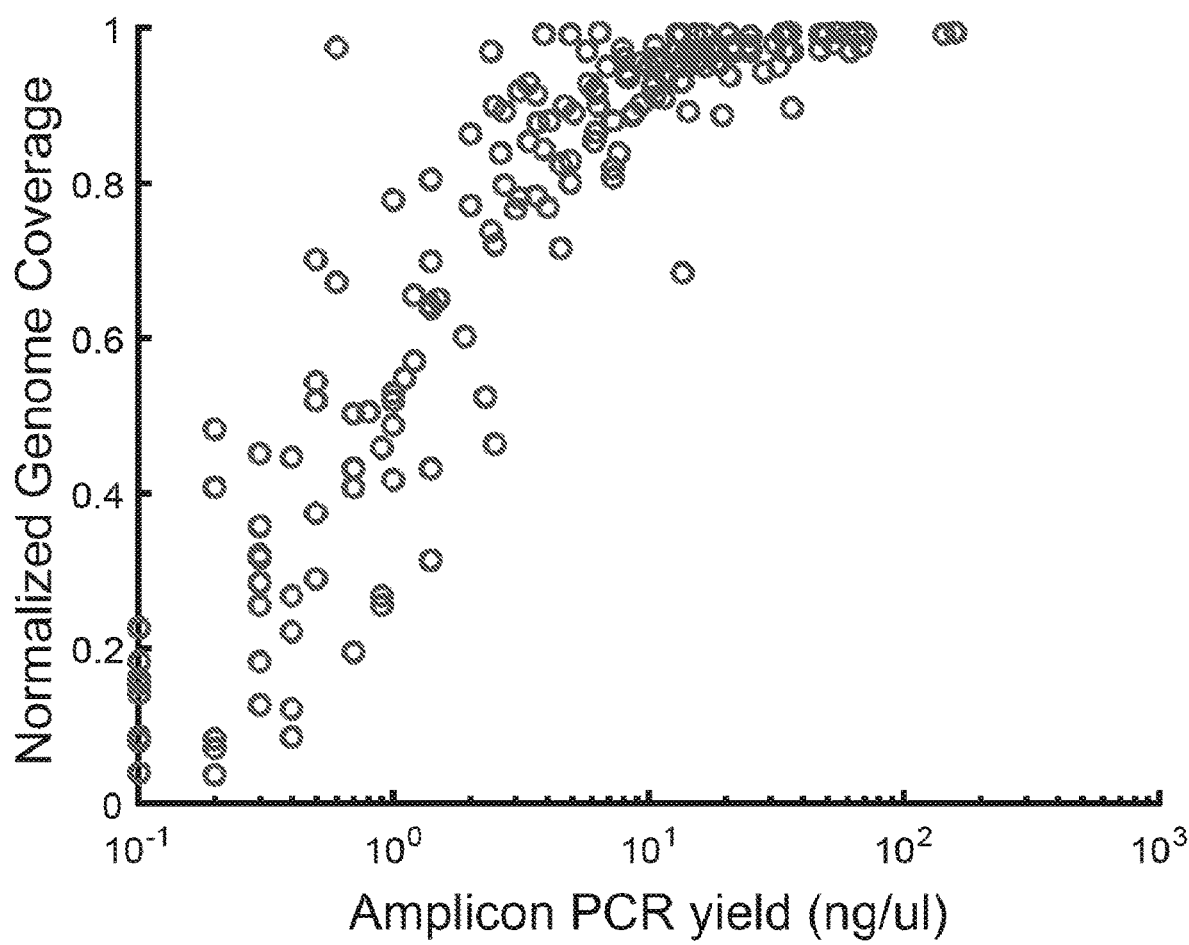
Figure 88C:
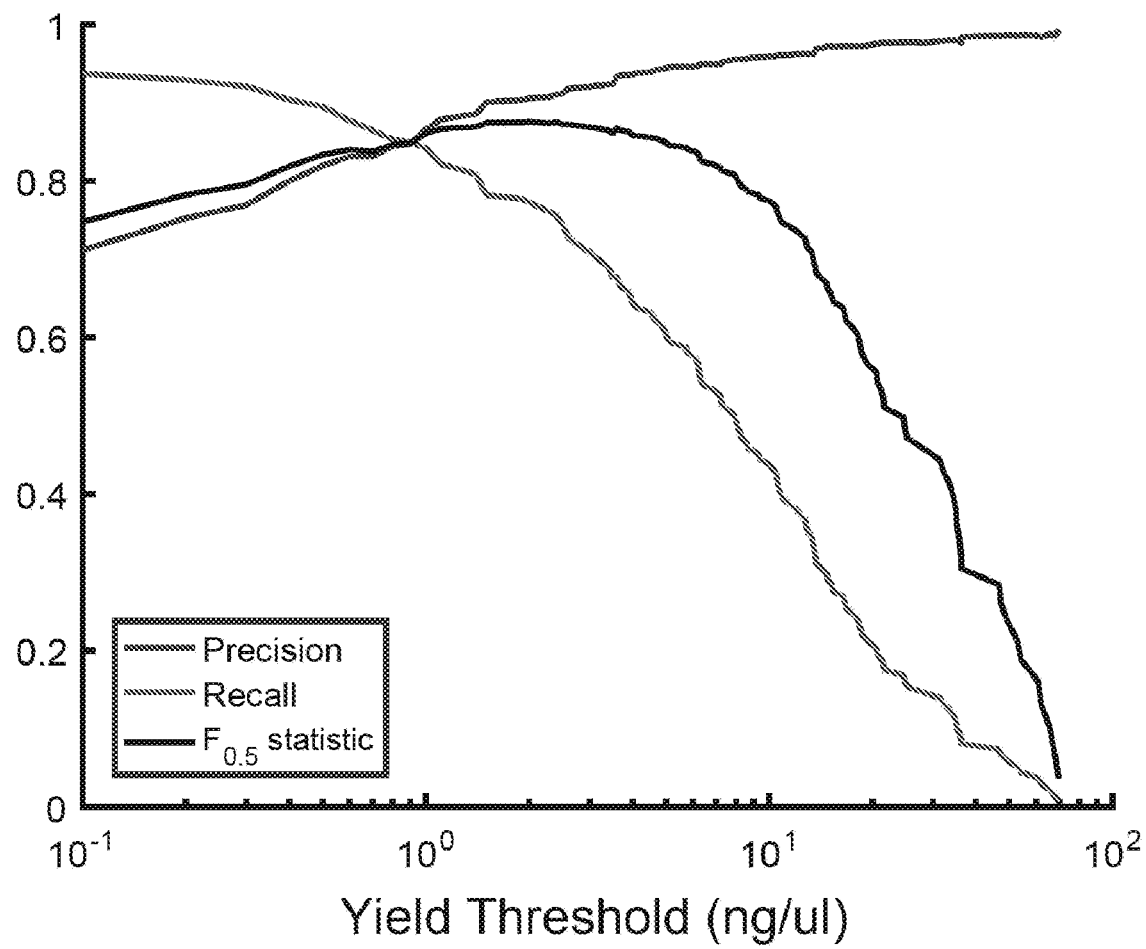

For the analysis of ZIKV samples from the 2015-2016 pandemic (FIG. 99B), thresholds were used to determine the presence or absence of ZIKV. The ZTKV SHERLOCK fluorescence threshold was determined using background subtracted fluorescence from 5 negative control samples: 4 single-donor healthy human urine samples and one no-input water control. Namely, for each sample s of these 5, we took the mean $m_s$ and standard deviation $\sigma_s$ of the fluorescence across 3 technical replicates. The threshold was set to the median of the 5 values $\{m_s+3\sigma_s\}$. The same calculation $\{m_s+3\sigma_s\}$ was performed using 1 no input control to determine the threshold. The threshold on amplicon PCR yield was determined using information from genome assemblies. First, the amplicon PCR yield was calculated for each sample by taking the minimum concentration from each of the two amplicon PCR pools (FIG. 87A). The objective is then to determine a yield that best predicts whether a particular targeted portion r of the genome is present in a sample (in this case, the RPA amplicon we are detecting with SHERLOCK). The probability that r is present in a sample s, $Pr_s(r)$, can be estimated as the fraction of the ZIKV genome that was sequenced and assembled from cDNA of s. (Calculating a probability across the genome is preferable to simply looking at whether there is coverage in the genome at r because lack of coverage does not necessarily indicate that r is not present.) The data for this analysis are from individual technical replicates from a recent genome sequencing study of the ZIKV pandemic (Metsky et al. Nature 546:411-415 (2017)). A plot of amplicon PCR yield vs. fraction of the genome covered is shown in FIG. 88B. The values $Pr_s(r)$ can be used to estimate precision and recall for a choice of threshold. In particular, an estimate of the number of samples that do have r is the sum of $Pr_s(r)$ across all samples. Similarly, among the samples P whose amplicon PCR yield exceeds a given threshold, the number that is correctly labeled as having presence of r is estimated as the sum of $Pr_s(r)$ across the samples in P. FIG. 87C shows precision and recall for each choice of threshold, as well as the F0.5 score, which is a composite metric that takes into account the threshold's ability to accurately classify samples as having the targeted portion of ZIKV. The amplicon PCR yield threshold was set to maximize the F0.5 score. For additional discussion of the sensitivity and specificity of SHERLOCK compared to amplicon PCR and other methods, see the Discussion.

DENV SHERLOCK fluorescence threshold was calculated similarly as described above with the ZIKV assay. Background subtracted fluorescence from 8 no input negative controls were used to determine the threshold. For each no input control s of these 8, we took the mean $m_s$ and standard deviation $\sigma_s$ of the fluorescence across 3 technical replicates and the threshold was set to the median of the 8 values $\{m_s+\_3\sigma_s\}$.

For multivirus or serotype panels, we calculated off-target fluorescence for each target against the other crRNAs in the panel. This was performed by calculating the percentage of target-specific fluorescence for an unmatched target:crRNA pair relative to the target-specific fluorescence observed for the matching target:crRNA pair at the 3 hour detection time point (when maximum fluorescence was observed or signal had saturated). Off-target fluorescence reported in the text was the maximum observed for the 4 targets in a given panel.

For SNP identification, background subtracted fluorescence values were calculated using ancestral-targeting and derived-targeting crRNAs. We took the ratio of the derived background-subtracted fluorescence to the ancestral background-subtracted fluorescence to determine the presence or absence of a SNP. For the HIV SNPs (FIG. 106), we calculated the SNP identification index, which is the ratio of the fluorescence ratio for the derived allele divided by the fluorescence ratio for the ancestral allele. The SNP identification index is equal to 1 if there is no discriminatory power between the two alleles and increases as the fluorescence ratios between the two alleles diverge. For additional discussion of the factors influencing the ease of differentiating individual SNPs using SHERLOCK, see the Discussion.

ZIKV and DENV Detection Experiments. PE243 (MF352141.1) seedstock cDNA was used at a stock concentration of $6.8\times10^4$ cp/μl. cDNA was serially diluted 1:10 in ultrapure water (Life Technologies), or healthy urine (Lee Biosolutions). 4-8 μl of each sample was inactivated, and 1-2 μl was used as input for RPA reactions. PE243 seedstock RNA was used at $2.72\times10^5$ cp/μl. The virus was originally isolated from a febrile patient with rash on May 13, 2015, and Vero cell passages were done at the FIOCRUZ Pernambuco laboratory (E. Marques), in Brazil in 2016 and at MIT Gehrke laboratory. PE243 is one of the first isolates from the Zika epidemic in Brazil (Donald et al. PLoS Negl. Trop. Dis. 10, e0005048 (2016)). RNA was serially diluted 1:10 in ultrapure water (Life Technologies), or healthy urine (Lee Biosolutions). 4-8 μl of each sample was inactivated, and 1-2 μl was used as input for RPA reactions. We used 14 mM MgAc for DENV detection and 17 mM MgAc for ZIKV detection.

A cultured isolate, ZIKV strain PRVABC59 (KU501215) from Puerto Rico (Donald et al. PLoS Negl. Trop. Dis. 10, e0005048 (2016); Lanciotti et al. Emerg. Infect. Dis. 22:933-935 (2016)), was acquired through the BEI repository in USA cat number ATCC VR-1843 and used for addition of virus to healthy urine, saliva, whole blood, and serum samples. PRVABC59 was cultured in insect and non-human primate cell lines. HuH-7 human hepatoma cells were used for deriving the infectious particles in the virus stock as described (Lambeth et al. J Clin. Microbiol. 43:3267-3272 (2005)). A cultured isolate, DENV2 strain New Guinea C (NGC), was used for dilution of virus in healthy saliva (Lee Biosolutions), whole blood (Research Blood Components), and serum (Millipore Sigma).

Viral Panel Experiments. In order to account for the sequence diversity between 4 different viruses in the flavivirus family (ZIKV, DENV, WNV, and YFV), we applied the method CATCH (Compact Aggregation of Targets for Comprehensive Hybridization) to search for conserved regions that would be suitable for a pan-flavivirus RPA primer pair. An implementation of this method is available on GitHub under the MIT license (github.com/broadinstitute/catch). This method allowed us to narrow our search for primer pairs within a conserved region of NS5.

For initial testing of the flavivirus panel and DENV panel, synthetically derived DNA templates were used as input at a concentration of $10^4$ copies/μl. A no input (water) control was used as a negative control for each of the crRNAs tested. In all panel experiments, 3 technical replicates were used. In all flavivirus panel experiments, the MgAc concentration in the RPA reaction was 20 mM while in all DENV panel experiments MgAc concentration in the RPA was 14 mM.

For initial testing of the flavivirus panel, ZIKV template sequence was derived from (KX197192), DENV (NC_001477.1), WNV (NC_09942.1), and YFV (AY968065.1). The RPA reaction amplifies a portion of NS5 for these flaviviruses.

For initial testing of the DENV panel, the DENV1 synthetic template sequence was derived from (KM204119.1), DENV2 (KM204118.1), DENV3 (KU050695.1), DENV4 (JQ822247.1). The RPA reaction amplifies a portion of the 3' UTR region of DENV 1-4. The DENV panel was additionally tested on extracted RNA from clinical samples and seed stocks.

SNP Identification Experiments. For region-specific SNP identification, synthetic templates containing 400-nt fragments of the ZIKV genome with ancestral or derived alleles were used to validate the performance of the SNP identification assay. In addition, ZIKV cDNA samples from 3 countries (USA, Honduras, and Dominican Republic) were used to confirm performance on mosquito pools and clinical samples. See Table 24 for additional information about these cDNA samples. PE243 seedstock cDNA (KX197192.1) was used as an outgroup control at 300 cp/µl. In addition, a no input (water) control was used. For the microcephaly-associated SNP identification experiments, synthetic templates containing a 400-nt fragment of the ZIKV genome with ancestral or derived alleles were used at 104 cp/µl, and PE243 seedstock cDNA was used at 300 cp/µl. For the HIV drug resistance SNP identification experiments, synthetic templates containing 468-nt fragments of the HIV genome with ancestral or derived alleles were used at 104 cp/µl. For a complete list of synthetic template names and sequences, see Table 30. In all SNP identification experiments, 3 technical replicates were used.

Discussion

Discussion of the sensitivity and specificity of SHERLOCK for ZIKV detection. We have shown that SHERLOCK is a very sensitive and specific method for nucleic acid detection. ZIKV detection was a key test of SHERLOCK's sensitivity, in large part because the ZIKV is notoriously challenging to detect due to low viral titers and sample degradation (Paz-Bailey et al. *N. Engl. J Med.* Doi:10.1056NEJMoa1613108 (2017)). We tested a set of 37 suspected positive patient samples and 3 mosquito pools from the 2015-16 ZIKV pandemic with both SHERLOCK and amplicon PCR to determine the presence or absence of ZIKV nucleic acid in a given sample. For 16 samples from these patients, we were able to compare SHERLOCK to two FDA-EUA-approved ZIKV diagnostics: 1) Hologic Aptima ZIKV assay, and 2) Altona RealStar Zika Virus RT-PCR assay.

To compare SHERLOCK and the Altona RealStar Zika Virus RT-PCR assay, we compared both assays on a set of 16 patient samples. We performed the two assays such that the reverse transcription conditions and input volumes were equivalent: 20-minute reverse transcription and 10 µl input. cDNA is diluted 1:4 from the RNA input due to the reverse transcription reaction conditions, thus the amount of RNA that we are using for SHERLOCK is ¼ the amount used by the Altona kit. We observed equal sensitivity between the two methods, with 10 of 16 samples positive by each method and 100% concordance overall (FIGS. 99C and 100).

We then compared SHERLOCK and the Altona assay to the Hologic Aptima Zika Virus Assay, which uses a much larger input volume (>500 µl). All 10 samples positive by both the Altona assay and SHERLOCK were positive by the Hologic assay (Table 25). Three samples were positive by the Hologic assay but not the other two assays, likely due to the >50× larger sample input volume for the Hologic assay. In conclusion, SHERLOCK has equivalent sensitivity to RT-PCR assays for ZIKV detection, and its sensitivity relative to the Hologic assay is limited by the input volume.

Our rationale for including amplicon PCR data was based on our observations while performing wide-scale genome sequencing during the ZIKV pandemic (Metsky et al. Nature 546:411-415 (2017)) that partial genomes were very common. This suggested that a genome-wide comparator would offer higher sensitivity than single-amplicon approaches such as RT-PCR. With the amplicon PCR approach, we quantified the amplicon PCR products using an Agilent tapestation and selected a threshold of 2 ng/µl for determining the presence or absence of ZIKV, which maximizes accuracy as measured by genome sequence coverage of the amplicon PCR product (FIG. 100, see Methods for details). There was high concordance (82.5%) between the two methods despite differences between the regions of the ZIKV genome they target (FIGS. 84C and 88A-C). The amplicon PCR method tiles the entire ZIKV genome, whereas SHERLOCK uses only one amplicon that at 128 nt long is shorter than the 300-400 nt long PCR amplicons (FIG. 101). Thus, it is possible for highly degraded samples (with short RNA fragments) to be more readily detected by SHERLOCK than by amplicon PCR. Conversely, if the SHERLOCK amplicon itself has degraded but other parts of the genome have not, then amplicon PCR will detect the remaining portions of the genome present in a sample.

This sensitivity of SHERLOCK is paired with high specificity. We have shown SNP-sensitivity, serotype identification, and species-level specificity using various SHERLOCK assays. We have also tested numerous negative controls, including healthy bodily fluids, water, and in some cases nucleic acid from other viruses. Based on these results, we do not expect to observe many false-positives (if any) using SHERLOCK.

Causes of variability in SHERLOCK performance. As discussed in the supplementary text of the original SHERLOCK paper, RPA performance is highly variable and depends on the template sequence, amplicon length, and other factors (Gootenberg et al. *Science* 356:438-442 (2017)). The Cas13 detection step amplifies fluorescent signals by a factor of 100 to 1,000 or more, depending on the input concentration of the RPA amplicon. As a result, SHERLOCK is fairly robust to variation in either RPA amplification or Cas13 detection, unless this variation is very large in magnitude.

To design multivirus and multi-serotype panels, we used degenerate RPA primers to capture the remarkable sequence diversity of related RNA viruses. In some cases, primer degeneracy can lead to variable amplification efficiency for different targets. In general, this can be managed by optimizing the RPA reaction (adjusting primer and magnesium concentrations, etc.).

In addition to RPA variation, we have observed some variation in the Cas13 detection step of SHERLOCK due to the effects of spacer GC content, stretches of polyUs, and secondary structure on crRNA performance. Some crRNAs are more active than others, and some crRNAs show more activity in absence of target (i.e., no input controls). We have also observed that some crRNAs are less pure than others after in vitro transcription. After purification, however, almost all crRNAs are highly active (with a few exceptions due to undesirable secondary structure of the spacers, such as when most of the spacer can pair with itself).

The lower ZIKV fluorescence in the flavivirus panel (FIG. 84B) may be due a combination of the factors discussed above (likewise for other crRNAs used in this study).

Factors influencing SNP discrimination by SHERLOCK. Different spacer RNA sequences were observed to have different levels of performance in the detection step of SHERLOCK. Factors that lead to these differences in performance were discussed above, but there are also implications related to SNP detection.

SNP detection relies on a pair of crRNAs that differ from a target sequence by one or two nucleotides, and thus have differential activity on a target molecule that is sequence-dependent. SNP discrimination is successful when the presence of a 2nd mismatch between the crRNA and target RNA leads to observable differences in collateral cleavage. Therefore, the following could limit the success of SNP discrimination:

- A single additional mismatch in a highly active crRNA may not reduce activity sufficiently for strong discrimination and has been observed for some crRNAs. Possible solutions include 1) diluting the RPA product prior to addition to the detection reaction, or 2) using a lower crRNA concentration.
- If one allele amplifies preferentially to the other during the RPA (due to a change in the secondary structure of the template), this could bias the output of SHERLOCK. We have not observed this, but it is a possibility.
- Wobble pairing of RNA will allow for some crRNAs to bind weakly in the absence of Watson-Crick base pairing. This has been observed for some of our A>G or G>A mutations (e.g., USA935). A "U" in the crRNA can bind to either the derived or ancestral nucleotide. However, even in this scenario it is easy to distinguish the two alleles as the G-targeting crRNA will contain a C nucleotide, which will not pair with A.

Given these limitations, crRNAs with lower activity (which can be achieved by shortening the spacer) could be better suited for SNP detection, and although wobble base pairing can have an effect on SHERLOCK's signal it will not completely abolish SNP identification.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (1008 sequences)

SEQ ID NO: 1 - protein, 1440 aa, Leptotrichia shahii C2c2-2
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYAEKIIEN

SEQ ID NO: 2 - protein, 1197 aa, Leptotrichia wadei (Lw2)
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Clostridium aminophilum DSM10710
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum DSM4847
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum DSM4847
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes WB4
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis FSLR9-0317
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeriaceae bacterium FSLM6-0635 (Listeria newyorkensis)
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei F0279
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus SB1003
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus R121
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus DE442; identical to SEQ ID NO: 14

SEQ ID NO: 16 - DNA, 47 bp, Artificial Sequence
  Synthetic
aattctaatacgactcactatagggggatcctctagaaatatggatt

SEQ ID NO: 17 - DNA, 22 bp, Artificial Sequence
  Synthetic
ctcgtatgttgtgtggaattgt

SEQ ID NO: 18 - DNA, 59 bp, Artificial Sequence
  Synthetic
aattctaatacgactcactatagggatcctctagaaatatggattacttggtagaacag

SEQ ID NO: 19 - DNA, 35 bp, Artificial Sequence
  Synthetic
gataaacacaggaaacagctatgaccatgattacg

SEQ ID NO: 20 - DNA, 54 bp, Artificial Sequence
  Synthetic
aattctaatacgactcactataggccgctgctaatgataggttgctactcacaa

SEQ ID NO: 21 - DNA, 34 bp, Artificial Sequence
  Synthetic
tcaatgtcagtcaccactattccatccacaacag

SEQ ID NO: 22 - DNA, 45 bp, Artificial Sequence
  Synthetic
gaaattaatacgactcactatagggcgtggcgcactacatgtact

SEQ ID NO: 23 - DNA, 30 bp, Artificial Sequence
  Synthetic
tgtcaatgtcagtcaccactattccatcca

SEQ ID NO: 24 - DNA, 49 bp, Artificial Sequence
  Synthetic
aattctaatacgactcactatagggtccagactcctacgggaggcwgca

SEQ ID NO: 25 - DNA, 52 bp, Artificial Sequence
  Synthetic
tttcgctctattctcatcagtttcatgtcctgtgtcattaccgcggctgctg

SEQ ID NO: 26 - DNA, 31 bp, Artificial Sequence
  Synthetic
ggtacacttcaggtatatttgaggttcattc

SEQ ID NO: 27 - DNA, 56 bp, Artificial Sequence
  Synthetic
gaaattaatacgactcactataggggttgatatgtcagagctttccagagaaataa

SEQ ID NO: 28 - DNA, 31 bp, Artificial Sequence
  Synthetic
acactaatattgattccttcagatatggact

SEQ ID NO: 29 - DNA, 55 bp, Artificial Sequence
  Synthetic
gaaattaatacgactcactatagggatcgttattcttacgcgttgtcattgaaag

SEQ ID NO: 30 - DNA, 30 bp, Artificial Sequence
  Synthetic
gaatctcttgaacccagtaggcagaggttg

SEQ ID NO: 31 - DNA, 57 bp, Artificial Sequence
  Synthetic
gaaattaatacgactcactatagggaaaggcctaagtgtccttctaccattattttg

SEQ ID NO: 32 - DNA, 32 bp, Artificial Sequence
  Synthetic
tttgtttttgatgttgttgttgtttttgtgtc

SEQ ID NO: 33 - DNA, 57 bp, Artificial Sequence
  Synthetic
gaaattaatacgactcactatagggaatgcattcatagccaaattctactggaaata

SEQ ID NO: 34 - DNA, 32 bp, Artificial Sequence
  Synthetic
gagtacgtccgcttcaccggctacccctgctc

SEQ ID NO: 35 - DNA, 57 bp, Artificial Sequence
  Synthetic
gaaattaatacgactcactatagggatagtcccctcggcgaacatggacccctacaa

SEQ ID NO: 36 - DNA, 57 bp, Artificial Sequence
  Synthetic
gaaattaatacgactcactatagggtcatgaagacctcacagtaaaaataggtgatt

SEQ ID NO: 37 - DNA, 32 bp, Artificial Sequence
  Synthetic
attcttaccatccacaaaatggatccagacaa

SEQ ID NO: 38 - DNA, 53 bp, Artificial Sequence
  Synthetic
gaaattaatacgactcactataggggcagcatgtcaagatcacagattttggg

SEQ ID NO: 39 - DNA, 29 bp, Artificial Sequence
  Synthetic
cctccttctgcatggtattctttctcttc

SEQ ID NO: 40 - DNA, 47 bp, Artificial Sequence; identical to SEQ ID NO: 16
  Synthetic

SEQ ID NO: 41 - DNA, 22 bp, Artificial Sequence
  Synthetic
ctcgtatgttgtgtggaattgt

SEQ ID NO: 42 - DNA, 49 bp, Artificial Sequence
  Synthetic
aattctaatacgactcactatagggggatcctctagaaatatggattac

SEQ ID NO: 43 - DNA, 22 bp, Artificial Sequence
  Synthetic
aaacacaggaaacagctatgac

SEQ ID NO: 44 - DNA, 49 bp, Artificial Sequence
  Synthetic
aattctaatacgactcactataggcctctagaaatatggattacttggt

SEQ ID NO: 45 - DNA, 22 bp, Artificial Sequence
  Synthetic
cgtatgttgtgtggaattgtga

SEQ ID NO: 46 - DNA, 60 bp, Artificial Sequence
  Synthetic
gaaattaatacgactcactatagggctgtcttgtctctcatggccgctggctggcttttc

SEQ ID NO: 47 - DNA, 33 bp, Artificial Sequence
  Synthetic
cgtacacaccgatggagccgccaaagtcctgtt

SEQ ID NO: 48 - DNA, 60 bp, Artificial Sequence
  Synthetic
gaaattaatacgactcactatagggagcaaatggaaactggcgaccaacggtttggcgat

SEQ ID NO: 49 - DNA, 32 bp, Artificial Sequence
  Synthetic
actgccccgaaacccggcatgtcgagatagga

SEQ ID NO: 50 - RNA, 67 nt, Artificial Sequence
  Synthetic
ggggauuuagacuaccccaaaaacgaaggggacuaaaacuagauugcuguucuaccaaguaauccau

SEQ ID NO: 51 - RNA, 28 nt, Artificial Sequence
  Synthetic
uagauugcuguucuaccaaguaauccau

SEQ ID NO: 52 - RNA, 67 nt, Artificial Sequence
  Synthetic
ggggauuuagacuaccccaaaaacgaaggggacuaaaaccauguagugcgccacgagcaaaaugaug

SEQ ID NO: 53 - RNA, 28 nt, Artificial Sequence
  Synthetic
cauguagugcgccacgagcaaaaugaug

SEQ ID NO: 54 - RNA, 67 nt, Artificial Sequence
  Synthetic
ggggauuuagacuaccccaaaaacgaaggggacuaaaacugcugccugcagcccugggaucaaguac

SEQ ID NO: 55 - RNA, 28 nt, Artificial Sequence
  Synthetic
ugcugccugcagcccugggaucaaguac

SEQ ID NO: 56 - RNA, 67 nt, Artificial Sequence
  Synthetic
ggggauuuagacuaccccaaaaacgaaggggacuaaaacacuuuacucccuuccuccccgcugaaag

SEQ ID NO: 57 - RNA, 28 nt, Artificial Sequence
  Synthetic
acuuuacucccuuccuccccgcugaaag

SEQ ID NO: 58 - RNA, 67 nt, Artificial Sequence
  Synthetic
ggggauuuagacuaccccaaaaacgaaggggacuaaaacaccucaucgccuuccuccccgcugaaag

SEQ ID NO: 59 - RNA, 28 nt, Artificial Sequence
  Synthetic
accucaucgccuuccuccccgcugaaag

SEQ ID NO: 60 - RNA, 67 nt, Artificial Sequence
  Synthetic
ggggauuuagacuaccccaaaaacgaaggggacuaaaacacuuacugcccuuccucccaacuuaaag

SEQ ID NO: 61 - RNA, 28 nt, Artificial Sequence
  Synthetic
acuuacugcccuuccucccaacuuaaag

SEQ ID NO: 62 - RNA, 67 nt, Artificial Sequence
  Synthetic
ggggauuuagacuaccccaaaaacgaaggggacuaaaacgaacccggaccuucgucgauggugaaag

SEQ ID NO: 63 - RNA, 28 nt, Artificial Sequence
  Synthetic
gaacccggaccuucgucgauggugaaag

SEQ ID NO: 64 - RNA, 67 nt, Artificial Sequence
  Synthetic
ggggauuuagacuaccccaaaaacgaaggggacuaaaacuuacacauauguucuucccuaauaacag

SEQ ID NO: 65 - RNA, 28 nt, Artificial Sequence
  Synthetic
uuacacauauguucuucccuaauaacag

SEQ ID NO: 66 - RNA, 67 nt, Artificial Sequence
  Synthetic
ggggauuuagacuaccccaaaaacgaaggggacuaaaacaugguuccgcgacgagguuggucagcgc

SEQ ID NO: 67 - RNA, 28 nt, Artificial Sequence
  Synthetic
augguuccgcgacgagguuggucagcgc

SEQ ID NO: 68 - RNA, 67 nt, Artificial Sequence
  Synthetic
ggggauuuagacuaccccaaaaacgaaggggacuaaaaccugccagacauucggugcgagcuggcgg

SEQ ID NO: 69 - RNA, 28 nt, Artificial Sequence
  Synthetic
cugccagacauucggugcgagcuggcgg

SEQ ID NO: 70 - RNA, 67 nt, Artificial Sequence
  Synthetic
ggggauuuagacuaccccaaaaacgaaggggacuaaaacaagauugcuguucuaccaaguaauccau

SEQ ID NO: 71 - RNA, 28 nt, Artificial Sequence
  Synthetic
aagauugcuguucuaccaaguaauccau

SEQ ID NO: 72 - RNA, 67 nt, Artificial Sequence
  Synthetic
ggggauuuagacuaccccaaaaacgaaggggacuaaaacuugauugcuguucuaccaaguaauccau

SEQ ID NO: 73 - RNA, 28 nt, Artificial Sequence
  Synthetic
uugauugcuguucuaccaaguaauccau

SEQ ID NO: 74 - RNA, 67 nt, Artificial Sequence
  Synthetic
ggggauuuagacuaccccaaaaacgaaggggacuaaaacuacauugcuguucuaccaaguaauccau

SEQ ID NO: 75 - RNA, 28 nt, Artificial Sequence
  Synthetic
uacauugcuguucuaccaaguaauccau

SEQ ID NO: 76 - RNA, 67 nt, Artificial Sequence
  Synthetic
ggggauuuagacuaccccaaaaacgaaggggacuaaaacuaguuugcuguucuaccaaguaauccau

SEQ ID NO: 77 - RNA, 28 nt, Artificial Sequence
  Synthetic
uaguuugcuguucuaccaaguaauccau

SEQ ID NO: 78 - RNA, 67 nt, Artificial Sequence
  Synthetic
ggggauuuagacuaccccaaaaacgaaggggacuaaaacuagaaugcuguucuaccaaguaauccau

SEQ ID NO: 79 - RNA, 28 nt, Artificial Sequence
  Synthetic
uagaaugcuguucuaccaaguaauccau

SEQ ID NO: 80 - RNA, 67 nt, Artificial Sequence
  Synthetic
ggggauuuagacuaccccaaaaacgaaggggacuaaaacuagauagcuguucuaccaaguaauccau

SEQ ID NO: 81 - RNA, 28 nt, Artificial Sequence
  Synthetic
uagauagcuguucuaccaaguaauccau

SEQ ID NO: 82 - RNA, 67 nt, Artificial Sequence
  Synthetic
ggggauuuagacuaccccaaaaacgaaggggacuaaaacuagauuccuguucuaccaaguaauccau

SEQ ID NO: 83 - RNA, 28 nt, Artificial Sequence
  Synthetic
uagauuccuguucuaccaaguaauccau

SEQ ID NO: 84 - RNA, 67 nt, Artificial Sequence
  Synthetic
ggggauuuagacuaccccaaaaacgaaggggacuaaaacuagauugguguucuaccaaguaauccau

SEQ ID NO: 85 - RNA, 28 nt, Artificial Sequence
  Synthetic
uagauugguguucuaccaaguaauccau

SEQ ID NO: 86 - RNA, 67 nt, Artificial Sequence
  Synthetic
ggggauuuagacuaccccaaaaacgaaggggacuaaaacuagauugcaguucuaccaaguaauccau

SEQ ID NO: 87 - RNA, 28 nt, Artificial Sequence
  Synthetic
uagauugcaguucuaccaaguaauccau

SEQ ID NO: 88 - RNA, 67 nt, Artificial Sequence
  Synthetic
ggggauuuagacuaccccaaaaacgaaggggacuaaaacuagauugcucuucuaccaaguaauccau

SEQ ID NO: 89 - RNA, 28 nt, Artificial Sequence
  Synthetic
uagauugcucuucuaccaaguaauccau

SEQ ID NO: 90 - RNA, 67 nt, Artificial Sequence
  Synthetic
ggggauuuagacuaccccaaaaacgaaggggacuaaaacggauacuucaugaugccagcugcuguuc

SEQ ID NO: 91 - RNA, 28 nt, Artificial Sequence
  Synthetic
ggauacuucaugaugccagcugcuguuc

SEQ ID NO: 92 - RNA, 67 nt, Artificial Sequence
  Synthetic
ggggauuuagacuaccccaaaaacgaaggggacuaaaacggauuguucaugaugccagcugcuguuc

SEQ ID NO: 93 - RNA, 28 nt, Artificial Sequence
  Synthetic
ggauuguucaugaugccagcugcuguuc

SEQ ID NO: 94 - RNA, 67 nt, Artificial Sequence
  Synthetic
ggggauuuagacuaccccaaaaacgaaggggacuaaaacggguacuucaugaugccagcugccguuc

SEQ ID NO: 95 - RNA, 28 nt, Artificial Sequence
  Synthetic
ggguacuucaugaugccagcugccguuc

SEQ ID NO: 96 - RNA, 67 nt, Artificial Sequence
  Synthetic
ggggauuuagacuaccccaaaaacgaaggggacuaaaacggguuguucaugaugccagcugccguuc

SEQ ID NO: 97 - RNA, 28 nt, Artificial Sequence
  Synthetic
ggguuguucaugaugccagcugccguuc

SEQ ID NO: 98 - RNA, 67 nt, Artificial Sequence
  Synthetic
ggggauuuagacuaccccaaaaacgaaggggacuaaaacgguuuaaucccuucugguguguugaugu

SEQ ID NO: 99 - RNA, 28 nt, Artificial Sequence
  Synthetic
gguuuaaucccuucugguguguugaugu

SEQ ID NO: 100 - RNA, 67 nt, Artificial Sequence
  Synthetic
ggggauuuagacuaccccaaaaacgaaggggacuaaaacgguaaaaucccuucugguguguugaugu

SEQ ID NO: 101 - RNA, 28 nt, Artificial Sequence
  Synthetic
gguaaaaucccuucugguguguugaugu

SEQ ID NO: 102 - RNA, 67 nt, Artificial Sequence
  Synthetic
ggggauuuagacuaccccaaaaacgaaggggacuaaaacggguuaaucccuucugguguguuuaugu

SEQ ID NO: 103 - RNA, 28 nt, Artificial Sequence
  Synthetic
ggguuaaucccuucugguguguuuaugu

SEQ ID NO: 104 - RNA, 67 nt, Artificial Sequence
  Synthetic
ggggauuuagacuaccccaaaaacgaaggggacuaaaacgggaaaaucccuucugguguguuuaugu

SEQ ID NO: 105 - RNA, 28 nt, Artificial Sequence
  Synthetic
gggaaaaucccuucugguguguuuaugu

SEQ ID NO: 106 - RNA, 62 nt, Artificial Sequence
  Synthetic
ggggauuuagacuaccccaaaaacgaaggggacuaaaacggauacuucaugaugccagcugc

SEQ ID NO: 107 - RNA, 23 nt, Artificial Sequence
  Synthetic
ggauacuucaugaugccagcugc

SEQ ID NO: 108 - RNA, 62 nt, Artificial Sequence
  Synthetic
ggggauuuagacuaccccaaaaacgaaggggacuaaaacggauuguucaugaugccagcugc

SEQ ID NO: 109 - RNA, 23 nt, Artificial Sequence
  Synthetic
ggauuguucaugaugccagcugc

SEQ ID NO: 110 - RNA, 62 nt, Artificial Sequence
  Synthetic
ggggauuuagacuaccccaaaaacgaaggggacuaaaacggguacuucaugaugccagcugc

SEQ ID NO: 111 - RNA, 23 nt, Artificial Sequence
  Synthetic
ggguacuucaugaugccagcugc

SEQ ID NO: 112 - RNA, 62 nt, Artificial Sequence
  Synthetic
ggggauuuagacuaccccaaaaacgaaggggacuaaaacggguuguucaugaugccagcugc

SEQ ID NO: 113 - RNA, 23 nt, Artificial Sequence
  Synthetic
ggguuguucaugaugccagcugc

SEQ ID NO: 114 - RNA, 67 nt, Artificial Sequence
  Synthetic
ggggauuuagacuaccccaaaaacgaaggggacuaaaacuacuacgcuucagccuacugcaaaucca

SEQ ID NO: 115 - RNA, 28 nt, Artificial Sequence
  Synthetic
uacuacgcuucagccuacugcaaaucca

SEQ ID NO: 116 - RNA, 67 nt, Artificial Sequence
  Synthetic
ggggauuuagacuaccccaaaaacgaaggggacuaaaacuauuacgcuucagccuacugcaaaucca

SEQ ID NO: 117 - RNA, 28 nt, Artificial Sequence
  Synthetic
uauuacgcuucagccuacugcaaaucca

SEQ ID NO: 118 - RNA, 67 nt, Artificial Sequence
  Synthetic
ggggauuuagacuaccccaaaaacgaaggggacuaaaacgacagaaauguccuuuucccaauccuau

SEQ ID NO: 119 - RNA, 28 nt, Artificial Sequence
  Synthetic
gacagaaauguccuuuucccaauccuau

SEQ ID NO: 120 - RNA, 67 nt, Artificial Sequence
  Synthetic
ggggauuuagacuaccccaaaaacgaaggggacuaaaacgauagaaauguccuuuucccaauccuau

SEQ ID NO: 121 - RNA, 28 nt, Artificial Sequence
  Synthetic
gauagaaauguccuuuucccaauccuau

SEQ ID NO: 122 - RNA, 67 nt, Artificial Sequence
  Synthetic
ggggauuuagacuaccccaaaaacgaaggggacuaaaacaccgacucuuuuuuguauuuccaguaga

SEQ ID NO: 123 - RNA, 28 nt, Artificial Sequence
  Synthetic
accgacucuuuuuuguauuuccaguaga

SEQ ID NO: 124 - RNA, 67 nt, Artificial Sequence
  Synthetic
ggggauuuagacuaccccaaaaacgaaggggacuaaaacacugacucuuuuuuguauuuccaguaga

SEQ ID NO: 125 - RNA, 28 nt, Artificial Sequence
  Synthetic
acugacucuuuuuuguauuuccaguaga

SEQ ID NO: 126 - RNA, 67 nt, Artificial Sequence
  Synthetic
ggggauuuagacuaccccaaaaacgaaggggacuaaaaccuacaccuucuaccaccaccuccgccag

SEQ ID NO: 127 - RNA, 28 nt, Artificial Sequence
  Synthetic
cuacaccuucuaccaccaccuccgccag

SEQ ID NO: 128 - RNA, 67 nt, Artificial Sequence
  Synthetic
ggggauuuagacuaccccaaaaacgaaggggacuaaaaccugcaccuucuaccaccaccuccgccag

SEQ ID NO: 129 - RNA, 28 nt, Artificial Sequence
  Synthetic
cugcaccuucuaccaccaccuccgccag

SEQ ID NO: 130 - RNA, 67 nt, Artificial Sequence
  Synthetic
ggggauuuagacuaccccaaaaacgaaggggacuaaaacgagagcaacaggaagcaggauuccaagu

SEQ ID NO: 131 - RNA, 28 nt, Artificial Sequence
  Synthetic
gagagcaacaggaagcaggauuccaagu

SEQ ID NO: 132 - RNA, 67 nt, Artificial Sequence
  Synthetic
ggggauuuagacuaccccaaaaacgaaggggacuaaaacgaaagcaacaggaagcaggauuccaagu

SEQ ID NO: 133 - RNA, 28 nt, Artificial Sequence
  Synthetic
gaaagcaacaggaagcaggauuccaagu

SEQ ID NO: 134 - RNA, 67 nt, Artificial Sequence
  Synthetic
ggggauuuagacuaccccaaaaacgaaggggacuaaaacccaggccaaaaucugugaucuugacaug

SEQ ID NO: 135 - RNA, 28 nt, Artificial Sequence
  Synthetic
ccaggccaaaaucugugaucuugacaug

SEQ ID NO: 136 - RNA, 67 nt, Artificial Sequence
  Synthetic
ggggauuuagacuaccccaaaaacgaaggggacuaaaaccccggccaaaaucugugaucuugacaug

SEQ ID NO: 137 - RNA, 28 nt, Artificial Sequence
  Synthetic
cccggccaaaaucugugaucuugacaug

SEQ ID NO: 138 - RNA, 67 nt, Artificial Sequence
  Synthetic
ggggauuuagacuaccccaaaaacgaaggggacuaaaacucaguguagcuagaccaaaaucaccuau

SEQ ID NO: 139 - RNA, 28 nt, Artificial Sequence
  Synthetic
ucaguguagcuagaccaaaaucaccuau

SEQ ID NO: 140 - RNA, 67 nt, Artificial Sequence
  Synthetic
ggggauuuagacuaccccaaaaacgaaggggacuaaaacucuguguagcuagaccaaaaucaccuau

SEQ ID NO: 141 - RNA, 28 nt, Artificial Sequence
  Synthetic
ucuguguagcuagaccaaaaucaccuau

SEQ ID NO: 142 - RNA, 64 nt, Leptotrichia wadei
  misc_feature (16)..(44): N represents any  nucleotide
  misc_feature (45)..(64): n is a, c, g, or u
gauuuagacuaccccaaaaagcaaggggacuaaaacnnnnnnnnnnnnnnnnnnnnnnnnnnnn

SEQ ID NO: 143 - RNA, 56 nt, Leptotrichia wadei
  misc_feature (7)..(44): "n" represents any nucleotide
  misc_feature (45)..(56): n is a, c, g, or u
ccaccccaauaucgaaggggacuaaaacnnnnnnnnnnnnnnnnnnnnnnnnnnnn

SEQ ID NO: 144 - RNA, 70 nt, Artificial Sequence
  Synthetic
uacccggggauccucuagaaauauggauuacuugguagaacagcaaucuacucgaccugcaggcaugcaa

SEQ ID NO: 145 - DNA, 64 bp, Artificial Sequence
  Synthetic
  misc_feature (11)..(11): "n" represents any nucleotide
gatttagactaccccaaaaagcaaggggactaaaacuagauugcuguucuaccaaguaauccau

SEQ ID NO: 146 - DNA, 10 bp, Artificial Sequence
  Synthetic
tagattgctg

SEQ ID NO: 147 - DNA, 10 bp, Artificial Sequence
  Synthetic
aagattgctg

SEQ ID NO: 148 - DNA, 10 bp, Artificial Sequence
  Synthetic
ttgattgctg

SEQ ID NO: 149 - DNA, 10 bp, Artificial Sequence
  Synthetic
tacattgctg

SEQ ID NO: 150 - DNA, 10 bp, Artificial Sequence
  Synthetic
tagtttgctg

SEQ ID NO: 151 - DNA, 10 bp, Artificial Sequence
  Synthetic
tagaatgctg

SEQ ID NO: 152 - DNA, 10 bp, Artificial Sequence
  Synthetic
tagatagctg

SEQ ID NO: 153 - DNA, 10 bp, Artificial Sequence
  Synthetic
tagattcctg

SEQ ID NO: 154 - DNA, 10 bp, Artificial Sequence
  Synthetic
tagattggtg

SEQ ID NO: 155 - DNA, 10 bp, Artificial Sequence
  Synthetic
tagattgcag

SEQ ID NO: 156 - DNA, 10 bp, Artificial Sequence
  Synthetic
tagattgctc

SEQ ID NO: 157 - DNA, 10 bp, Artificial Sequence
  Synthetic
atctaacgac

SEQ ID NO: 158 - DNA, 10 bp, Artificial Sequence
  Synthetic
atgtaacgac

SEQ ID NO: 159 - DNA, 10 bp, Artificial Sequence
  Synthetic
atgtatcgac

SEQ ID NO: 160 - RNA, 58 nt, Flavivirus sp.
gugcugcccagaagagaacagcagcuggcaucaugaagaaucccguuguggauggaau

SEQ ID NO: 161 - RNA, 64 nt, Artificial Sequence
  Synthetic
gauuuagacuaccccaaaaagcaaggggacuaaaacggauacuucaugaugccagcugcuguuc

SEQ ID NO: 162 - RNA, 58 nt, Artificial Sequence; identical to SEQ ID NO: 160
  Synthetic

SEQ ID NO: 163 - RNA, 63 nt, Artificial Sequence
  Synthetic
gauuuagacuacccaaaaagcaaggggacuaaaacggauacuucaugaugccagcugcuguuc

SEQ ID NO: 164 - RNA, 58 nt, Artificial Sequence
  Synthetic
gugcugcccagaagagaacggcagcuggcaucaugaagaaccccguuguggauggaau

SEQ ID NO: 165 - RNA, 58 nt, Flavivirus sp.; identical to SEQ ID NO: 160

SEQ ID NO: 166 - RNA, 28 nt, Flavivirus sp.
ggauuguucaugaugccagcugcuguuc

SEQ ID NO: 167 - RNA, 28 nt, Flavivirus sp.
ggauacuucaugaugccagcugcuguuc

SEQ ID NO: 168 - RNA, 58 nt, Flavivirus sp.
gugcugcccagaagagaacggcagcuggcaucaugaagaacccuguuguggauggaau

SEQ ID NO: 169 - RNA, 28 nt, Flavivirus sp.
ggguacuucaugaugccagcugccguuc

SEQ ID NO: 170 - RNA, 28 nt, Flavivirus sp.
ggguuguucaugaugccagcugccguuc

SEQ ID NO: 171 - RNA, 58 nt, Flavivirus sp.
aaaugcugcuggacaacaucaacacaccagaagggauuauaccagcucucuuugaacc

SEQ ID NO: 172 - RNA, 28 nt, Artificial Sequence
  Synthetic
gguaaaaucccuucugguguguugaugu

SEQ ID NO: 173 - RNA, 28 nt, Artificial Sequence
  Synthetic
gguuuaaucccuucugguguguugaugu

SEQ ID NO: 174 - RNA, 58 nt, Flavivirus sp
aaaugcuccuugacaacauaaacacaccagaagggauuaucccagcccucuuugagcc

SEQ ID NO: 175 - RNA, 28 nt, Artificial Sequence
  Synthetic
ggguuaaucccuucugguguguuuaugu

SEQ ID NO: 176 - RNA, 28 nt, Artificial Sequence
  Synthetic
gggaaaaucccuucugguguguuuaugu

SEQ ID NO: 177 - RNA, 39 nt, Artificial Sequence
  Synthetic
caccgcagcaugucaagaucacagauuuugggcgggcca

SEQ ID NO: 178 - RNA, 28 nt, Artificial Sequence
  Synthetic
cccggccaaaaucugugaucuugacaug

SEQ ID NO: 179 - RNA, 28 nt, Artificial Sequence
  Synthetic
ccaggccaaaaucugugaucuugacaug

SEQ ID NO: 180 - RNA, 39 nt, Artificial Sequence
  Synthetic
caguaaaaauaggugauuuuggucuagcuacagagaaau

SEQ ID NO: 181 - RNA, 28 nt, Artificial Sequence
  Synthetic
ucuguguagcuagaccaaaaucaccuau

SEQ ID NO: 182 - RNA, 28 nt, Artificial Sequence
  Synthetic
ucaguguagcuagaccaaaaucaccuau

SEQ ID NO: 183 - DNA, 25 bp, Artificial Sequence
  Synthetic
  misc_feature (25)..(25): 3ThioMC3-D
ttataactattcctaaaaaaaaaaa

SEQ ID NO: 184 - DNA, 26 bp, Artificial Sequence
  Synthetic
  misc_feature (1)..(1): 5ThioMC6-D
aaaaaaaaaactcccctaataacaat

SEQ ID NO: 185 - RNA, 45 nt, Artificial Sequence
  Synthetic
ggguaggaauaguuauaauuucccuuucccauuguuauuagggag

SEQ ID NO: 186 - DNA, 66 bp, Artificial Sequence
  Synthetic
tgtggttggtgtggttggttcatggtcatattggtttttttttttttttccaaccacagtctctgt

SEQ ID NO: 187 - DNA, 35 bp, Artificial Sequence
  Synthetic
ggttggtagtctcgaattgctctctttcactggcc

SEQ ID NO: 188 - DNA, 48 bp, Artificial Sequence
  Synthetic
gaaattaatacgactcactatagggggttggttcatggtcatattggt

SEQ ID NO: 189 - DNA, 57 bp, Artificial Sequence
  Synthetic
gaaattaatacgactcactatagggggttggtgtggttggttcatggtcatattggt

SEQ ID NO: 190 - DNA, 31 bp, Artificial Sequence
  Synthetic
ggccagtgaaagagagcaattcgagactacc

SEQ ID NO: 191 - RNA, 64 nt, Artificial Sequence
  Synthetic
gauuuagacuaccccaaaaacgaaggggacuaaaacccagugaaagagagcaauucgagacuac

SEQ ID NO: 192 - RNA, 64 nt, Artificial Sequence
  Synthetic
gauuuagacuaccccaaaaacgaaggggacuaaaacaaagagagcaauucgagacuaccaacca

SEQ ID NO: 193 - RNA, 64 nt, Artificial Sequence
  Synthetic
gauuuagacuaccccaaaaacgaaggggacuaaaacagacuaccaaccacagagacugugguug

SEQ ID NO: 194 - DNA, 106 bp, Artificial Sequence
  Synthetic
gttagatcgcaagcatatcattgcgcttgcgatctaactgctgcgccgccgggaaaatactgtacggttagatcgcatagtctcgaattgctctctttcactggcc

SEQ ID NO: 195 - DNA, 71 bp, Artificial Sequence
  Synthetic
gttagatcgcaagcatatcattgcgcttgcgatctaactgctgcgccgccgggaaaatactgtacggttag

SEQ ID NO: 196 - DNA, 35 bp, Artificial Sequence
  Synthetic
atcgcatagtctcgaattgctctctttcactggcc

SEQ ID NO: 197 - DNA, 50 bp, Artificial Sequence
  Synthetic
gaaattaatacgactcactatagggatcgcaagcatatcattgcgcttgc

SEQ ID NO: 198 - DNA, 31 bp, Artificial Sequence
  Synthetic
ggccagtgaaagagagcaattcgagactatg

SEQ ID NO: 199 - RNA, 64 nt, Artificial Sequence
  Synthetic
gauuuagacuaccccaaaaacgaaggggacuaaaacccagugaaagagagcaauucgagacuau

SEQ ID NO: 200 - RNA, 64 nt, Artificial Sequence
  Synthetic
gauuuagacuaccccaaaaacgaaggggacuaaaacagagcaauucgagacuaugcgaucuaac

SEQ ID NO: 201 - RNA, 64 nt, Artificial Sequence
  Synthetic
gauuuagacuaccccaaaaacgaaggggacuaaaacacuaugcgaucuaaccguacaguauuuu

SEQ ID NO: 202 - DNA, 66 bp, Artificial Sequence; identical to SEQ ID NO: 186
  Synthetic

SEQ ID NO: 203 - DNA, 25 bp, Artificial Sequence
  Synthetic
ggttggtagtctcgaattgctctct

SEQ ID NO: 204 - protein, 18 aa, Leptotrichia shahii
IRKFTKIGTNERNRILHA

SEQ ID NO: 205 - protein, 15 aa, Leptotrichia shahii
SIRNYISHFYIVRNP

SEQ ID NO: 206 - protein, 18 aa, Lachnospiraceae bacterium MA2020
LYSLKSMLYSMRNSSFHF

SEQ ID NO: 207 - protein, 15 aa, Lachnospiraceae bacterium MA2020
IFRNEIDHFHYFYDR

SEQ ID NO: 208 - protein, 18 aa, Lachnospiraceae bacterium
LTDLKDVIYSMRNDSFHY

SEQ ID NO: 209 - protein, 15 aa, Lachnospiraceae bacterium
ELRNYIEHFRYYSSF

SEQ ID NO: 210 - protein, 18 aa, Clostridium aminophilum DSM 10710
ADDLRKAIYSLRNETFHF

SEQ ID NO: 211 - protein, 15 aa, Clostridium aminophilum DSM 10710
DVRKYVDHFKYYATS

SEQ ID NO: 212 - protein, 18 aa, Carnobacterium gallinarum DSM 4847
IWALRGSVQQIRNEIFHS

SEQ ID NO: 213 - protein, 15 aa, Carnobacterium gallinarum
KIRNQTAHLSVLQLE

SEQ ID NO: 214 - protein, 18 aa, Carnobacterium gallinarum DSM 4847
LWAIRGAVQRVRNQIFHQ

SEQ ID NO: 215 - protein, 15 aa, Carnobacterium gallinarum DSM 4847
EIRNNIAHLHVLRND

SEQ ID NO: 216 - protein, 18 aa, Paludibacter propionicigenes WB4
LWGIRGAVQQIRNNVNHY

SEQ ID NO: 217 - protein, 15 aa, Paludibacter propionicigenes WB4
DIRNHIAHFNYLTKD

SEQ ID NO: 218 - protein, 18 aa, Listeria weihenstephanensis FSL R9-0317
IWAIRGSIQQIRNEVYHC

SEQ ID NO: 219 - protein, 15 aa, Listeria weihenstephanensis FSL R9-0317
NARNHIAHLNYLSLK

SEQ ID NO: 220 - protein, 18 aa, Listeriaceae bacterium FSL M6-0635
IWAIRGSIQQIRNEVYHC

SEQ ID NO: 221 - protein, 15 aa, Listeriaceae bacterium FSL M6-0635
NARNHIAHLNYLSLK

SEQ ID NO: 222 - protein, 18 aa, Leptotrichia wadei F0279
VFALLRYLRGCRNQTFHL

SEQ ID NO: 223 - protein, 15 aa, Leptotrichia wadei F0279
YIRNYIAHFNYIPHA

SEQ ID NO: 224 - protein, 18 aa, Rhodobacter capsulatus SB 1003
VFALLRYLRGCRNQTFHL

SEQ ID NO: 225 - protein, 15 aa, Artificial Sequence
  Synthetic
QTRKDLAHFNVLDRA

SEQ ID NO: 226 - protein, 18 aa, Rhodobacter capsulatus R12
VFALLRYLRGCRNQTFHL

SEQ ID NO: 227 - protein, 15 aa, Rhodobacter capsulatus R121
QTRKDLAHFNVLDRA

SEQ ID NO: 228 - protein, 18 aa, Rhodobacter capsulatus DE442
VFALLRYLRGCRNQTFHL

SEQ ID NO: 229 - protein, 15 aa, Rhodobacter capsulatus DE-442
QTRKDLAHFNVLDRA

SEQ ID NO: 230 - protein, 18 aa, Leptotrichia wadei (Lw2)
FANIDEAISSIRHGIVHF

SEQ ID NO: 231 - protein, 15 aa, Leptotrichia wadei (Lw2)
YIRNYIAHFNYIPHA

SEQ ID NO: 232 - protein, 18 aa, Listeria seeligen
SWGLRGAIAPIRNEIIHL

SEQ ID NO: 233 - protein, 15 aa, Listeria seeligen
EKRNNISHFNYLNGQ

SEQ ID NO: 234 - RNA, 62 nt, Artificial Sequence
  Synthetic
ggggauuuagacuaccccaaaaacgaaggggacuaaaacuagaaugcuguucuaccaaguaa

SEQ ID NO: 235 - RNA, 23 nt, Artificial Sequence
  Synthetic
uagaaugcuguucuaccaaguaa

SEQ ID NO: 236 - RNA, 62 nt, Artificial Sequence
  GGGGAUUUAGACUACCCCAAAAACGAAGGGGACUAAAACUAGAUAGCUGUUCUACCAAGUAA
ggggauuuagacuaccccaaaaacgaaggggacuaaaacuagauagcuguucuaccaaguaa

SEQ ID NO: 237 - RNA, 23 nt, Artificial Sequence
  Synthetic
uagauagcuguucuaccaaguaa

SEQ ID NO: 238 - RNA, 62 nt, Artificial Sequence
  Synthetic
ggggauuuagacuaccccaaaaacgaaggggacuaaaacuagauuccuguucuaccaaguaa

SEQ ID NO: 239 - RNA, 23 nt, Artificial Sequence
  Synthetic
uagauuccuguucuaccaaguaa

SEQ ID NO: 240 - RNA, 59 nt, Artificial Sequence
  Synthetic
ggggauuuagacuaccccaaaaacgaaggggacuaaaacaagauugcuguucuaccaag

SEQ ID NO: 241 - RNA, 20 nt, Artificial Sequence
  Synthetic
aagauugcuguucuaccaag

SEQ ID NO: 242 - RNA, 59 nt, Artificial Sequence
  Synthetic
ggggauuuagacuaccccaaaaacgaaggggacuaaaacuugauugcuguucuaccaag

SEQ ID NO: 243 - RNA, 20 nt, Artificial Sequence
  Synthetic
uugauugcuguucuaccaag

SEQ ID NO: 244 - RNA, 59 nt, Artificial Sequence
  Synthetic
ggggauuuagacuaccccaaaaacgaaggggacuaaaacuaguuugcuguucuaccaag

SEQ ID NO: 245 - RNA, 20 nt, Artificial Sequence
  Synthetic
uaguuugcuguucuaccaag

SEQ ID NO: 246 - RNA, 59 nt, Artificial Sequence
  Synthetic
ggggauuuagacuaccccaaaaacgaaggggacuaaaacuagaaugcuguucuaccaag

SEQ ID NO: 247 - RNA, 20 nt, Artificial Sequence
  Synthetic
uagaaugcuguucuaccaag

SEQ ID NO: 248 - RNA, 59 nt, Artificial Sequence
  Synthetic
ggggauuuagacuaccccaaaaacgaaggggacuaaaacuagauagcuguucuaccaag

SEQ ID NO: 249 - RNA, 20 nt, Artificial Sequence
  Synthetic
uagauagcuguucuaccaag

SEQ ID NO: 250 - RNA, 59 nt, Artificial Sequence
  Synthetic
ggggauuuagacuaccccaaaaacgaaggggacuaaaacuagauuccuguucuaccaag

SEQ ID NO: 251 - RNA, 20 nt, Artificial Sequence
  UAGAUUCCUGUUCUACCAAG
uagauuccuguucuaccaag

SEQ ID NO: 252 - RNA, 67 nt, Artificial Sequence
  Synthetic
ggggauuuagacuaccccaaaaacgaaggggacuaaaaccuagauugcuguucuaccaaguaaucca

SEQ ID NO: 253 - RNA, 28 nt, Artificial Sequence
  Synthetic
cuagauugcuguucuaccaaguaaucca

SEQ ID NO: 254 - RNA, 67 nt, Artificial Sequence
  Synthetic
ggggauuuagacuaccccaaaaacgaaggggacuaaaacgaagauugcuguucuaccaaguaaucca

SEQ ID NO: 255 - RNA, 28 nt, Artificial Seqeunce
  Synthetic
gaagauugcuguucuaccaaguaaucca

SEQ ID NO: 256 - RNA, 67 nt, Artificial Sequence
  Synthetic
ggggauuuagacuaccccaaaaacgaaggggacuaaaacguugauugcuguucuaccaaguaaucca

SEQ ID NO: 257 - RNA, 28 nt, Artificial Sequence
  Synthetic
guugauugcuguucuaccaaguaaucca

SEQ ID NO: 258 - RNA, 67 nt, Artificial Sequence
  Synthetic
ggggauuuagacuaccccaaaaacgaaggggacuaaaacguaguuugcuguucuaccaaguaaucca

SEQ ID NO: 259 - RNA, 28 nt, Artificial Sequence
  Synthetic
guaguuugcuguucuaccaaguaaucca

SEQ ID NO: 260 - RNA, 67 nt, Artificial Sequence
  Synthetic
ggggauuuagacuaccccaaaaacgaaggggacuaaaacguagaaugcuguucuaccaaguaaucca

SEQ ID NO: 261 - RNA, 28 nt, Artificial Sequence
  Synthetic
guagaaugcuguucuaccaaguaaucca

SEQ ID NO: 262 - RNA, 67 nt, Artificial Sequence
  Synthetic
ggggauuuagacuaccccaaaaacgaaggggacuaaaacguagauagcuguucuaccaaguaaucca

SEQ ID NO: 263 - RNA, 28 nt, Artificial Sequence
  Synthetic
guagauagcuguucuaccaaguaaucca

SEQ ID NO: 264 - RNA, 67 nt, Artificial Sequence
  Synthetic
ggggauuuagacuaccccaaaaacgaaggggacuaaaacacuagauugcuguucuaccaaguaaucc

SEQ ID NO: 265 - RNA, 28 nt, Artificial Sequence
  Synthetic
acuagauugcuguucuaccaaguaaucc

SEQ ID NO: 266 - RNA, 67 nt, Artificial Sequence
  Synthetic
ggggauuuagacuaccccaaaaacgaaggggacuaaaacagaagauugcuguucuaccaaguaaucc

SEQ ID NO: 267 - RNA, 28 nt, Artificial Sequence
  Synthetic
agaagauugcuguucuaccaaguaaucc

SEQ ID NO: 268 - RNA, 67 nt, Artificial Sequence
  Synthetic
ggggauuuagacuaccccaaaaacgaaggggacuaaaacaguugauugcuguucuaccaaguaaucc

SEQ ID NO: 269 - RNA, 28 nt, Artificial Sequence
  Synthetic
aguugauugcuguucuaccaaguaaucc

SEQ ID NO: 270 - RNA, 67 nt, Artificial Sequence
  Synthetic
ggggauuuagacuaccccaaaaacgaaggggacuaaaacaguaguuugcuguucuaccaaguaaucc

SEQ ID NO: 271 - RNA, 28 nt, Artificial Sequence
  Synthetic
aguaguuugcuguucuaccaaguaaucc

SEQ ID NO: 272 - RNA, 67 nt, Artificial Sequence
  Synthetic
ggggauuuagacuaccccaaaaacgaaggggacuaaaacaguagaaugcuguucuaccaaguaaucc

SEQ ID NO: 273 - RNA, 28 nt, Artificial Sequence
  Synthetic
aguagaaugcuguucuaccaaguaaucc

SEQ ID NO: 274 - RNA, 67 nt, Artificial Sequence
  Synthetic
ggggauuuagacuaccccaaaaacgaaggggacuaaaacaguagauagcuguucuaccaaguaaucc

SEQ ID NO: 275 - RNA, 28 nt, Artificial Sequence
  Synthetic
aguagauagcuguucuaccaaguaaucc

SEQ ID NO: 276 - RNA, 67 nt, Artificial Sequence
  Synthetic
ggggauuuagacuaccccaaaaacgaaggggacuaaaacgacuagauugcuguucuaccaaguaauc

SEQ ID NO: 277 - RNA, 28 nt, Artificial Sequence
  Synthetic
gacuagauugcuguucuaccaaguaauc

SEQ ID NO: 278 - RNA, 67 nt, Artificial Sequence
  Synthetic
ggggauuuagacuaccccaaaaacgaaggggacuaaaacgagaagauugcuguucuaccaaguaauc

SEQ ID NO: 279 - RNA, 28 nt, Artificial Sequence
  Synthetic
gagaagauugcuguucuaccaaguaauc

SEQ ID NO: 280 - RNA, 67 nt, Artificial Sequence
  Synthetic
ggggauuuagacuaccccaaaaacgaaggggacuaaaacgaguugauugcuguucuaccaaguaauc

SEQ ID NO: 281 - RNA, 28 nt, Artificial Sequence
  Synthetic
gaguugauugcuguucuaccaaguaauc

SEQ ID NO: 282 - RNA, 67 nt, Artificial Sequence
  Synthetic
ggggauuuagacuaccccaaaaacgaaggggacuaaaacgaguaguuugcuguucuaccaaguaauc

SEQ ID NO: 283 - RNA, 28 nt, Artificial Sequence
  Synthetic
gaguaguuugcuguucuaccaaguaauc

SEQ ID NO: 284 - RNA, 67 nt, Artificial Sequence
  Synthetic
ggggauuuagacuaccccaaaaacgaaggggacuaaaacgaguagaaugcuguucuaccaaguaauc

SEQ ID NO: 285 - RNA, 28 nt, Artificial Sequence
  Synthetic
gaguagaaugcuguucuaccaaguaauc

SEQ ID NO: 286 - RNA, 67 nt, Artificial Sequence
  Synthetic
ggggauuuagacuaccccaaaaacgaaggggacuaaaacgaguagauagcuguucuaccaaguaauc

SEQ ID NO: 287 - RNA, 28 nt, Artificial Sequence
  Synthetic
gaguagauagcuguucuaccaaguaauc

SEQ ID NO: 288 - RNA, 176 nt, Artificial Sequence
  Synthetic
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 289 - RNA, 176 nt, Artificial Sequence
  Synthetic
gggggccagugaauucgagcucgguacccggggauccucuagaaauauggauuacuugguagaacagcaaucuagucgaccugcaggcaugcaagcuuggcguaaucauggucauagcuguuuccuguguuuauccgcucacaauuccacacaacauacgagccggaagcauaaag

SEQ ID NO: 290 - RNA, 176 nt, Artificial Sequence
  Synthetic
gggggccagugaauucgagcucgguacccggggauccucuagaaauauggauuacuugguagaacagcaaucuaaucgaccugcaggcaugcaagcuuggcguaaucauggucauagcuguuuccuguguuuauccgcucacaauuccacacaacauacgagccggaagcauaaag

SEQ ID NO: 291 - RNA, 176 nt, Artificial Sequence
  Synthetic
gggggccagugaauucgagcucgguacccggggauccucuagaaauauggauuacuugguagaacagcaaucuauucgaccugcaggcaugcaagcuuggcguaaucauggucauagcuguuuccuguguuuauccgcucacaauuccacacaacauacgagccggaagcauaaag

SEQ ID NO: 292 - DNA, 173 bp, Artificial Sequence
  Synthetic
ggccagtgaattcgagctcggtacccggggatcctctagaaatatggattacttggtagaacagcaatctactcgacctgcaggcatgcaagcttggcgtaatcatggtcatagctgtttcctgtgtttatccgctcacaattccacacaacatacgagccggaagcataaag

SEQ ID NO: 293 - DNA, 189 bp, Artificial Sequence
  Synthetic
gagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactat

SEQ ID NO: 294 - RNA, 334 nt, Artificial Sequence
  Synthetic
agcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 295 - RNA, 334 nt, Artificial Sequence
  Synthetic
ggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccuc

SEQ ID NO: 296 - RNA, 337 nt, Artificial Sequence
  Synthetic
gggagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 297 - RNA, 173 nt, Artificial Sequence
  Synthetic
gggaaccuugauaguggcuaucauucugcuuguggcacacuauauguacuugaucccaggccuacaggcagcagcagcgcgugcugcccagaagagaacagcagcuggcaucaugaagaaucccguuguggauggaauagugguaacugacauugacacaaugacaauugacc

SEQ ID NO: 298 - RNA, 173 nt, Artificial Sequence
  Synthetic
ggggacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacc

SEQ ID NO: 299 - RNA, 173 nt, Artificial Sequence
  Synthetic
gggaguacauauucaggggccaaccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggu

SEQ ID NO: 300 - RNA, 173 nt, Artificial Sequence
  Synthetic
gggaguacauuuacaugggacagccuucaaacaacgaugaggaucacgcucauuggacagaagcaaaaaugcuccuugacaacauaaacacaccagaagggauuaucccagcccucuuugagccggagagaggaaaaagugcagcaauagacggggaauacagacugcggggu

SEQ ID NO: 301 - RNA, 176 nt, Artificial Sequence
  Synthetic
gggggccagugaauucgagcucgguacccggggauccucuagaaauauggauuacuugguagaacagcaauguacucgaccugcaggcaugcaagcuuggcguaaucauggucauagcuguuuccuguguuuauccgcucacaauuccacacaacauacgagccggaagcauaaag

SEQ ID NO: 302 - RNA, 176 nt, Artificial Sequence
  Synthetic
gggggccagugaauucgagcucgguacccggggauccucuagaaauauggauuacuugguagaacagcuauguacucgaccugcaggcaugcaagcuuggcguaaucauggucauagcuguuuccuguguuuauccgcucacaauuccacacaacauacgagccggaagcauaaag

SEQ ID NO: 303 - RNA, 62 nt, Artificial Sequence
  Synthetic
ggggauuuagacuaccccaaaaacgaaggggacuaaaacaagauugcuguucuaccaaguaa

SEQ ID NO: 304 - RNA, 23 nt, Artificial Sequence
  Synthetic
aagauugcuguucuaccaaguaa

SEQ ID NO: 305 - RNA, 62 nt, Artificial Sequence
  Synthetic
ggggauuuagacuaccccaaaaacgaaggggacuaaaacuugauugcuguucuaccaaguaa

SEQ ID NO: 306 - RNA, 23 nt, Artificial Sequence
  Synthetic
uugauugcuguucuaccaaguaa

SEQ ID NO: 307 - RNA, 62 nt, Artificial Sequence
  Synthetic
ggggauuuagacuaccccaaaaacgaaggggacuaaaacuaguuugcuguucuaccaaguaa

SEQ ID NO: 308 - RNA, 23 nt, Artificial Sequence
  Synthetic
uaguuugcuguucuaccaaguaa

SEQ ID NO: 309 - protein, 1159 aa, Leptorichia buccalis C-1013-b
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 310 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 311 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 312 - protein, 1373 aa, Eubacteriaceae bacterium CHKCI004
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 313 - protein, 1334 aa, Lachnospiraceae bacterium NK4A144
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 314 - protein, 500 aa, Chlorofexus aggregans S1
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 315 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 316 - protein, 1235 aa, Thalassospira sp. TSL5-1
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 317 - protein, 1312 aa, Pseudobutyrivibrio sp. OR37
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 318 - protein, 1343 aa, Butyrivibrio sp. YAB3001
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 319 - protein, 1276 aa, Blautia sp Marseille-P2398
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 320 - protein, 1168 aa, Leptotrichia sp. Marseille-P300
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 321 - protein, 1138 aa, Bacterioides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 322 - protein, 697 aa, Porphyromonadaceae bacterium KH3CP3RA
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 323 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 324 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 325 - protein, 1001 aa, Artificial Sequence
  Consensus Sequence
  misc_feature (7)..(9): Xaa can be any naturally occurring amino acid
  misc_feature (11)..(11): Xaa can be any naturally occurring amino acid
  misc_feature (14)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (42)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  MISC_FEATURE (90)..(90): "Xaa" at position 90 is Amino Acid code "J" - Leu or Ile
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (116)..(116): Xaa can be any naturally occurring amino acid
  misc_feature (121)..(121): Xaa can be any naturally occurring amino acid
  misc_feature (128)..(130): Xaa can be any naturally occurring amino acid
  misc_feature (133)..(133): Xaa can be any naturally occurring amino acid
  misc_feature (145)..(145): Xaa can be any naturally occurring amino acid
  misc_feature (148)..(148): Xaa can be any naturally occurring amino acid
  misc_feature (167)..(167): Xaa can be any naturally occurring amino acid
  misc_feature (174)..(174): Xaa can be any naturally occurring amino acid
  misc_feature (192)..(192): Xaa can be any naturally occurring amino acid
  misc_feature (194)..(195): Xaa can be any naturally occurring amino acid
  misc_feature (199)..(199): Xaa can be any naturally occurring amino acid
  misc_feature (202)..(203): Xaa can be any naturally occurring amino acid
  misc_feature (206)..(206): Xaa can be any naturally occurring amino acid
  misc_feature (217)..(219): Xaa can be any naturally occurring amino acid
  misc_feature (228)..(228): Xaa can be any naturally occurring amino acid
  misc_feature (233)..(233): Xaa can be any naturally occurring amino acid
  MISC_FEATURE (236)..(236): "Xaa" at position 90 is Amino Acid code "J" - Leu or Ile
  misc_feature (243)..(243): Xaa can be any naturally occurring amino acid
  misc_feature (245)..(245): Xaa can be any naturally occurring amino acid
  misc_feature (262)..(262): Xaa can be any naturally occurring amino acid
  MISC_FEATURE (267)..(267): "Xaa" at position 90 is Amino Acid code "J" - Leu or Ile
  misc_feature (277)..(278): Xaa can be any naturally occurring amino acid
  misc_feature (282)..(282): Xaa can be any naturally occurring amino acid
  misc_feature (287)..(287): Xaa can be any naturally occurring amino acid
  misc_feature (307)..(307): Xaa can be any naturally occurring amino acid
  misc_feature (314)..(314): Xaa can be any naturally occurring amino acid
  misc_feature (320)..(321): Xaa can be any naturally occurring amino acid
  misc_feature (333)..(333): Xaa can be any naturally occurring amino acid
  misc_feature (343)..(343): Xaa can be any naturally occurring amino acid
  misc_feature (357)..(357): Xaa can be any naturally occurring amino acid
  misc_feature (367)..(367): Xaa can be any naturally occurring amino acid
  misc_feature (371)..(371): Xaa can be any naturally occurring amino acid
  misc_feature (374)..(375): Xaa can be any naturally occurring amino acid
  misc_feature (378)..(378): Xaa can be any naturally occurring amino acid
  misc_feature (392)..(392): Xaa can be any naturally occurring amino acid
  misc_feature (402)..(402): Xaa can be any naturally occurring amino acid
  misc_feature (414)..(415): Xaa can be any naturally occurring amino acid
  MISC_FEATURE (418)..(418): "Xaa" at position 90 is Amino Acid code "J" - Leu or Ile
  misc_feature (446)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (467)..(467): Xaa can be any naturally occurring amino acid
  misc_feature (489)..(489): Xaa can be any naturally occurring amino acid
  misc_feature (500)..(500): Xaa can be any naturally occurring amino acid
  misc_feature (510)..(510): Xaa can be any naturally occurring amino acid
  misc_feature (514)..(514): Xaa can be any naturally occurring amino acid
  misc_feature (528)..(529): Xaa can be any naturally occurring amino acid
  misc_feature (532)..(532): Xaa can be any naturally occurring amino acid
  misc_feature (539)..(539): Xaa can be any naturally occurring amino acid
  misc_feature (547)..(548): Xaa can be any naturally occurring amino acid
  misc_feature (551)..(551): Xaa can be any naturally occurring amino acid
  misc_feature (553)..(554): Xaa can be any naturally occurring amino acid
  misc_feature (565)..(565): Xaa can be any naturally occurring amino acid
  misc_feature (576)..(576): Xaa can be any naturally occurring amino acid
  misc_feature (587)..(588): Xaa can be any naturally occurring amino acid
  misc_feature (600)..(600): Xaa can be any naturally occurring amino acid
  misc_feature (604)..(605): Xaa can be any naturally occurring amino acid
  misc_feature (622)..(622): Xaa can be any naturally occurring amino acid
  misc_feature (627)..(627): Xaa can be any naturally occurring amino acid
  misc_feature (629)..(629): Xaa can be any naturally occurring amino acid
  misc_feature (655)..(655): Xaa can be any naturally occurring amino acid
  misc_feature (662)..(662): Xaa can be any naturally occurring amino acid
  misc_feature (682)..(682): Xaa can be any naturally occurring amino acid
  misc_feature (686)..(686): Xaa can be any naturally occurring amino acid
  MISC_FEATURE (688)..(688): "Xaa" at position 90 is Amino Acid code "J" - Leu or Ile
  misc_feature (691)..(691): Xaa can be any naturally occurring amino acid
  misc_feature (698)..(698): Xaa can be any naturally occurring amino acid
  misc_feature (706)..(706): Xaa can be any naturally occurring amino acid
  misc_feature (723)..(723): Xaa can be any naturally occurring amino acid
  MISC_FEATURE (737)..(737): "Xaa" at position 90 is Amino Acid code "J" - Leu or Ile
  misc_feature (738)..(738): Xaa can be any naturally occurring amino acid
  misc_feature (760)..(761): Xaa can be any naturally occurring amino acid
  misc_feature (771)..(771): Xaa can be any naturally occurring amino acid
  misc_feature (773)..(773): Xaa can be any naturally occurring amino acid
  misc_feature (779)..(779): Xaa can be any naturally occurring amino acid
  misc_feature (786)..(786): Xaa can be any naturally occurring amino acid
  misc_feature (790)..(790): Xaa can be any naturally occurring amino acid
  misc_feature (798)..(798): Xaa can be any naturally occurring amino acid
  misc_feature (800)..(800): Xaa can be any naturally occurring amino acid
  misc_feature (834)..(834): Xaa can be any naturally occurring amino acid
  misc_feature (843)..(843): Xaa can be any naturally occurring amino acid
  misc_feature (851)..(852): Xaa can be any naturally occurring amino acid
  misc_feature (866)..(866): Xaa can be any naturally occurring amino acid
  misc_feature (870)..(870): Xaa can be any naturally occurring amino acid
  misc_feature (873)..(873): Xaa can be any naturally occurring amino acid
  misc_feature (877)..(877): Xaa can be any naturally occurring amino acid
  misc_feature (889)..(889): Xaa can be any naturally occurring amino acid
  misc_feature (896)..(896): Xaa can be any naturally occurring amino acid
  misc_feature (916)..(916): Xaa can be any naturally occurring amino acid
  misc_feature (923)..(923): Xaa can be any naturally occurring amino acid
  misc_feature (936)..(936): Xaa can be any naturally occurring amino acid
  misc_feature (962)..(962): Xaa can be any naturally occurring amino acid
  misc_feature (966)..(966): Xaa can be any naturally occurring amino acid
  misc_feature (970)..(970): Xaa can be any naturally occurring amino acid
  misc_feature (985)..(985): Xaa can be any naturally occurring amino acid
  misc_feature (996)..(996): Xaa can be any naturally occurring amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXXKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKXLKYYFPXKXAKNSNDKIFEKQELKKXWIHQXENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKXGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYXGKXLDFEKKXMKDLAELXPYDQNDGENPIVNRNIXLAKKYGTLNLLEKXXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 326 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 327 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 328 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 329 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 330 - protein, 1115 aa, Bacterioides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 331 - protein, 953 aa, Alistipes sp. ZOR0009
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 332 - protein, 1322 aa, Prevotella sp. MA2016
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 333 - protein, 1322 aa, Prevotella sp. MA2016; identical to SEQ ID NO: 332

SEQ ID NO: 334 - protein, 1095 aa, Riemeralla anatipesifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 335 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 336 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 337 - protein, 1159 aa, Myroides odoratimimus HMPREF9712_03108
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 338 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 339 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 340 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 341 - protein, 1090 aa, Prevotella sp. P5-125
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 342 - protein, 1150 aa, Flavobacterium branchiphilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 343 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 344 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 345 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 346 - protein, 1175 aa, Porphyromonas sp. COT-052OH4946
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 347 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 348 - protein, 1134 aa, Prevotella intermedia 17
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 349 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 350 - protein, 1127 aa, Prevotella buccae ATCC 33574; identical to SEQ ID NO: 328

SEQ ID NO: 351 - protein, 1125 aa, Prevotella pallens HMPREF9144 1146
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 352 - protein, 1157 aa, Myroides odoratimim HMPREF9714 02132
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 353 - protein, 1157 aa, Myoides odoratimimus HMPREF9711 00870
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 354 - protein, 1224 aa, Bergeyella zoohelcum ATCC 43767; identical to SEQ ID NO: 326

SEQ ID NO: 355 - protein, 1150 aa, Prevotella saccharolytica HMPREF9151 01387
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 356 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 357 - protein, 1115 aa, Bacteroides pyrogenes F0041
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 358 - protein, 1135 aa, Porphyromonas gingivalis F0568
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 359 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 360 - protein, 1135 aa, Porphyromonas gingivalis W4087
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 361 - protein, 1125 aa, Prevotella intermedia ZT
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 362 - protein, 1161 aa, Bacterioides bacterium  GWA2 31 9
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 363 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 364 - protein, 1156 aa, Chryseobacterium carnipullorum SAMN05444360 11366
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 365 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 366 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 367 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 368 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 369 - protein, 1125 aa, Prevotella pallens; identical to SEQ ID NO: 351

SEQ ID NO: 370 - protein, 1157 aa, Myroides odoratimimus; identical to SEQ ID NO: 352

SEQ ID NO: 371 - protein, 1157 aa, Myroides odoratimimus; identical to SEQ ID NO: 353

SEQ ID NO: 372 - protein, 1127 aa, Prevotella sp. MSX73
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 373 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 374 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 375 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 376 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 377 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 378 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 379 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 380 - protein, 1135 aa, Porphyromonas gingivalis; identical to SEQ ID NO: 358

SEQ ID NO: 381 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 382 - protein, 1135 aa, Porphyromonas gingivalis; identical to SEQ ID NO: 359

SEQ ID NO: 383 - protein, 1135 aa, Porphyromonas gingivalis; identical to SEQ ID NO: 360

SEQ ID NO: 384 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 385 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 386 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 387 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 388 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 389 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 390 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 391 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 392 - protein, 1119 aa, Poprhyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 393 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 394 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 395 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 396 - protein, 1090 aa, Prevotella sp. P5-119
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 397 - protein, 1090 aa, Prevotella sp. P4-76
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 398 - protein, 1090 aa, Prevotella sp. P5-60
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 399 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 400 - protein, 1155 aa, Flavobacterium sp. 316
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 401 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 402 - protein, 1145 aa, Chryseobacterium sp. YR477
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 403 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 404 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 405 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 406 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 407 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 408 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 409 - protein, 950 aa, Rimerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 410 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 411 - protein, 1095 aa, Riemerella anatispestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 412 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 413 - protein, 1133 aa, Richenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 414 - RNA, 25 nt, Artificial sequence
  RNA aptamer
gggaacaaagcugaaguacuuaccc

SEQ ID NO: 415 - DNA, 18 bp, Artificial Sequence
  Synthetic G-quadraplex
gggtagggcgggttggga

SEQ ID NO: 416 - RNA, 12 nt, Artificial sequence
  synthetic linker
  misc_feature (1)..(1): /5Biosg/ biotin tag
  misc_feature (12)..(12): /31AbRQSp/ Iowa black quencher
ucucguacguuc

SEQ ID NO: 417 - RNA, 24 nt, Artificial Sequence
  Synthetic tag
  misc_feature (1)..(1): /5Biosg/ biotin tag
  misc_feature (24)..(24): /3IAbRQSp/ Iowa Black Quencher
ucucguacguucucucguacguuc

SEQ ID NO: 418 - DNA, 10 bp, Artificial Sequence
  synthetic
tatatatata

SEQ ID NO: 419 - DNA, 15 bp, Artificial Sequence
  Synthetic
gtcgtcgtcgtcgtc

SEQ ID NO: 420 - DNA, 22 bp, Artificial Sequence
  Synthetic primer
gtggaattgtgagcggataaac

SEQ ID NO: 421 - DNA, 21 bp, Artificial Sequence
  Synthetic primer
aacagcaatctactcgacctg

SEQ ID NO: 422 - skipped

SEQ ID NO: 423 - DNA, 19 bp, Artificial Sequence
  Synthetic primer
ctatgaccatgattacgcc

SEQ ID NO: 424 - DNA, 25 bp, Artificial Sequence
  Synthetic
ggttggtagtctcgaattgctctct

SEQ ID NO: 425 - RNA, 64 nt, Artificial Sequence
  Synthetic
gauuuagacuaccccaaaaagcaaggggacuaaaacuagauugcuguucuaccaaguaauccau

SEQ ID NO: 426 - RNA, 23 nt, Artificial Sequence
  Synthetic
uagauugcuguucuaccaaguaa

SEQ ID NO: 427 - RNA, 20 nt, Artificial Sequence
  Synthetic
uagauugcuguucuaccaag

SEQ ID NO: 428 - RNA, 28 nt, Artificial Sequence
  Synthetic
auggauuacuugguagaacagcaaucua

SEQ ID NO: 429 - RNA, 28 nt, Artificial Sequence
  Sytthetic
auggauuacuugguagaacagcaaugua

SEQ ID NO: 430 - RNA, 17 nt, Artificial Sequence
  Synthetic
uagauugcuguucuacc

SEQ ID NO: 431 - RNA, 17 nt, Artificial Sequence
  Synthetic
aagauugcuguucuacc

SEQ ID NO: 432 - RNA, 17 nt, Artificial Sequence
  Synthetic
uugauugcuguucuacc

SEQ ID NO: 433 - RNA, 17 nt, Artificial Sequence
  Synthetic
uaguuugcuguucuacc

SEQ ID NO: 434 - RNA, 17 nt, Artificial Sequence
  Synthetic
uagaaugcuguucuacc

SEQ ID NO: 435 - RNA, 17 nt, Artificial Sequence
  Synthetic
uagauagcuguucuacc

SEQ ID NO: 436 - RNA, 17 nt, Artificial Sequence
  Synthetic
uagauuccuguucuacc

SEQ ID NO: 437 - RNA, 30 nt, Artificial Sequence
  Synthetic
auggauuacuugguagaacagaaucuacuc

SEQ ID NO: 438 - RNA, 30 nt, Artificial Sequence
  Synthetic
auggauuacuugguagaacagaauguacuc

SEQ ID NO: 439 - RNA, 28 nt, Artificial Sequence
  Synthetic
aagauugcuguucuaccaaguaauccau

SEQ ID NO: 440 - RNA, 28 nt, Artificial Sequence
  Synthetic
uugauugcuguucuaccaaguaauccau

SEQ ID NO: 441 - RNA, 28 nt, Artificial Sequence
  Synthetic
uaguuugcuguucuaccaaguaauccau

SEQ ID NO: 442 - RNA, 28 nt, Artificial Sequence
  Synthetic
uagaaugcuguucuaccaaguaauccau

SEQ ID NO: 443 - RNA, 28 nt, Artificial Sequence
  Synthetic
uagauagcuguucuaccaaguaauccau

SEQ ID NO: 444 - RNA, 28 nt, Artificial Sequence
  Synthetic
uagauuccuguucuaccaaguaauccau

SEQ ID NO: 445 - RNA, 28 nt, Artificial Sequence
  Synthetic
cuagauugcuguucuaccaaguaaucca

SEQ ID NO: 446 - RNA, 28 nt, Artificial Sequence
  Synthetic
gaagauugcuguucuaccaaguaaucca

SEQ ID NO: 447 - RNA, 28 nt, Artificial Sequence
  Synthetic
guugauugcuguucuaccaaguaaucca

SEQ ID NO: 448 - RNA, 28 nt, Artificial Sequence
  Synthetic
guaguuugcuguucuaccaaguaaucca

SEQ ID NO: 449 - RNA, 28 nt, Artificial Sequence
  Synthetic
guagaaugcuguucuaccaaguaaucca

SEQ ID NO: 450 - RNA, 28 nt, Artificial Sequence
  Synthetic
guagauagcuguucuaccaaguaaucca

SEQ ID NO: 451 - RNA, 28 nt, Artificial Sequence
  Synthetic
acuagauugcuguucuaccaaguaaucc

SEQ ID NO: 452 - RNA, 28 nt, Artificial Sequence
  Synthetic
agaagauugcuguucuaccaaguaaucc

SEQ ID NO: 453 - RNA, 28 nt, Artificial Sequence
  Synthetic
aguugauugcuguucuaccaaguaaucc

SEQ ID NO: 454 - RNA, 28 nt, Artificial Sequence
  Synthetic
aguaguuugcuguucuaccaaguaaucc

SEQ ID NO: 455 - RNA, 28 nt, Artificial Sequence
  Synthetic
aguagaaugcuguucuaccaaguaaucc

SEQ ID NO: 456 - RNA, 28 nt, Artificial Sequence
  Synthetic
aguagauagcuguucuaccaaguaaucc

SEQ ID NO: 457 - RNA, 28 nt, Artificial Sequence
  Synthetic
gacuagauugcuguucuaccaaguaauc

SEQ ID NO: 458 - RNA, 28 nt, Artificial Sequence
  Synthetic
gagaagauugcuguucuaccaaguaauc

SEQ ID NO: 459 - RNA, 28 nt, Artificial Sequence
  Synthetic
gaguugauugcuguucuaccaaguaauc

SEQ ID NO: 460 - RNA, 28 nt, Artificial Sequence
  Synthetic
gaguaguuugcuguucuaccaaguaauc

SEQ ID NO: 461 - RNA, 28 nt, Artificial Sequence
  Synthetic
gaguagaaugcuguucuaccaaguaauc

SEQ ID NO: 462 - RNA, 28 nt, Artificial Sequence
  Synthetic
gaguagauagcuguucuaccaaguaauc

SEQ ID NO: 463 - DNA, 57 bp, Artificial Sequence
  P. falciparum target
gaaattaatacgactcactatagggttattgcaattattaatcttgaacgaggaatg

SEQ ID NO: 464 - DNA, 57 bp, Artificial Sequence
  P. falciparum
gaaattaatacgactcactataggggattgacagattaatagctctttcttgatttc

SEQ ID NO: 465 - DNA, 32 bp, Artificial Sequence
  P. falciparum
atttttcttgtccaaacaattcatcatatctt

SEQ ID NO: 466 - DNA, 32 bp, Artificial Sequence
  P. falciparum
ttcaatttcaaataagaatatagtgtactcgc

SEQ ID NO: 467 - DNA, 57 bp, Artificial Sequence
  P. falciparum
gaaattaatacgactcactatagggttcttattagcagaacaaagaagtttaacaac

SEQ ID NO: 468 - DNA, 57 bp, Artificial Sequence
  P. falciparum
gaaattaatacgactcactatagggattttatgcaatgttaaaaactgttccaagta

SEQ ID NO: 469 - DNA, 32 bp, Artificial Sequence
  P. falciparum
taattgacatccaatccataataaagcataga

SEQ ID NO: 470 - DNA, 32 bp, Artificial Sequence
  P. falciparum
gaattatagttgttaaacttctttgttctgct

SEQ ID NO: 471 - DNA, 89 bp, Artificial Sequence
  P. falciparum
cctagtaagcatgattcatcagattgtggttttagtccccttcgtttttggggtagtctaaatcccctatagtgagtcgtattaatttc

SEQ ID NO: 472 - DNA, 89 bp, Artificial Sequence
  P. falciparum
ggatggtgatgcatggccgtttttagttgttttagtccccttcgtttttggggtagtctaaatcccctatagtgagtcgtattaatttc

SEQ ID NO: 473 - DNA, 89 bp, Artificial Sequence
  P falciparum
caatttaaaatgatttttggtgctagaggttttagtccccttcgtttttggggtagtctaaatcccctatagtgagtcgtattaatttc

SEQ ID NO: 474 - DNA, 89 bp, Artificial Sequence
  P. falciparum
gctggtttagtaattgtattattatcatgttttagtccccttcgtttttggggtagtctaaatcccctatagtgagtcgtattaatttc

SEQ ID NO: 475 - DNA, 124 bp, Artificial Sequence
  Synthetic
tacttggtagaacagcaatctactcgacctgcaggcatgcaagcttggcgtaatcatggtcatagctgtttcctgtgtttatccgctcacaattccacacaacatacgagccggaagcataaag

SEQ ID NO: 476 - DNA, 124 bp, Artificial Sequence
  Synthetic
atgaaccatcttgtcgttagatgagctggacgtccgtacgttcgaaccgcattagtaccagtatcgacaaaggacacaaataggcgagtgttaaggtgtgttgtatgctcggccttcgtattta

SEQ ID NO: 477 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 478 - protein, 1276 aa, Blautia sp.Marseille-P2398 (C2-29); identical to SEQ ID NO: 319

SEQ ID NO: 479 - protein, 948 aa, Artificial Sequence; identical to SEQ ID NO: 378
  Riemerella anatipestifer

SEQ ID NO: 480 - protein, 948 aa, Artificial Sequence; identical to SEQ ID NO: 403
  Riemerella anatipestifer

SEQ ID NO: 481 - protein, 950 aa, Artificial Sequence; identical to SEQ ID NO: 409
  Riemerella anatipestifer

SEQ ID NO: 482 - protein, 953 aa, Alistipes sp. ZOR0009; identical to SEQ ID NO: 331

SEQ ID NO: 483 - protein, 1036 aa, Artificial Sequence; identical to SEQ ID NO: 365
  Chryseobacterium ureilyticum

SEQ ID NO: 484 - protein, 1090 aa, Artificial Sequence; identical to SEQ ID NO: 341
  Prevotella sp.

SEQ ID NO: 485 - protein, 1090 aa, Artificial Sequence; identical to SEQ ID NO: 396
  Prevotella sp.

SEQ ID NO: 486 - protein, 1090 aa, Artificial Sequence; identical to SEQ ID NO: 397
  Prevotella sp.

SEQ ID NO: 487 - protein, 1090 aa, Artificial Sequence; identical to SEQ ID NO: 398
  Prevotella sp.

SEQ ID NO: 488 - protein, 1095 aa, Artificial Sequence; identical to SEQ ID NO: 334
  Riemerella anatispestifer

SEQ ID NO: 489 - protein, 1095 aa, Artificial Sequence; identical to SEQ ID NO: 411
  Riemerella anatispestifer

SEQ ID NO: 490 - protein, 1115 aa, Artificial Sequence; identical to SEQ ID NO: 330
  Synthetic

SEQ ID NO: 491 - protein, 1115 aa, Artificial Sequence; identical to SEQ ID NO: 357
  Bacteroides pyogenes

SEQ ID NO: 492 - protein, 1116 aa, Artificial Sequence; identical to SEQ ID NO: 386
  Prevotella pleuritidis

SEQ ID NO: 493 - protein, 1119 aa, Artificial Sequence; identical to SEQ ID NO: 345
  Porphyromonas gingivalis

SEQ ID NO: 494 - protein, 1119 aa, Artificial Sequence; identical to SEQ ID NO: 373
  Porphyromonas gingivalis

SEQ ID NO: 495 - protein, 1119 aa, Artificial Sequence; identical to SEQ ID NO: 375
  Porphyromonas gingivalis

SEQ ID NO: 496 - protein, 1119 aa, Artificial Sequence; identical to SEQ ID NO: 387
  Porphyromonas gingivalis

SEQ ID NO: 497 - protein, 1119 aa, Artificial Sequence; identical to SEQ ID NO: 389
  Porphyromonas gulae

SEQ ID NO: 498 - protein, 1119 aa, Artificial Sequence; identical to SEQ ID NO: 390
  Porphyromonas gulae

SEQ ID NO: 499 - protein, 1119 aa, Artificial Sequence; identical to SEQ ID NO: 392
  Porphyromonas gulae

SEQ ID NO: 500 - protein, 1119 aa, Artificial Sequence; identical to SEQ ID NO: 407
  Porphyromonas gingivalis

SEQ ID NO: 501 - protein, 1120 aa, Artificial Sequence; identical to SEQ ID NO: 338
  Prevotella intermedia

SEQ ID NO: 502 - protein, 1124 aa, Artificial Sequence; identical to SEQ ID NO: 335
  Prevotella aurantiaca

SEQ ID NO: 503 - protein, 1125 aa, Artificial Sequence; identical to SEQ ID NO: 351
  Prevotella pallens

SEQ ID NO: 504 - protein, 1125 aa, Artificial Sequence; identical to SEQ ID NO: 361
  Prevotella intermedia ZT

SEQ ID NO: 505 - protein, 1125 aa, Artificial Sequence; identical to SEQ ID NO: 351
  Prevotella pallens

SEQ ID NO: 506 - protein, 1126 aa, Artificial Sequence; identical to SEQ ID NO: 327
  Prevotella intermedia

SEQ ID NO: 507 - protein, 1127 aa, Artificial Sequence; identical to SEQ ID NO: 328
  Prevotella buccae

SEQ ID NO: 508 - protein, 1127 aa, Artificial Sequence; identical to SEQ ID NO: 328
  Prevotella buccae

SEQ ID NO: 509 - protein, 1127 aa, Artificial Sequence; identical to SEQ ID NO: 328
  Prevotella buccae

SEQ ID NO: 510 - protein, 1127 aa, Artificial Sequence; identical to SEQ ID NO: 372
  Prevotella sp. MSX73

SEQ ID NO: 511 - protein, 1131 aa, Artificial Sequence; identical to SEQ ID NO: 399
  Phaeodactylibacter xiamenensis

SEQ ID NO: 512 - protein, 1132 aa, Artificial Sequence; identical to SEQ ID NO: 347
  Prevotella intermedia

SEQ ID NO: 513 - protein, 1133 aa, Artificial Sequence; identical to SEQ ID NO: 349
  Prevotella intermedia

SEQ ID NO: 514 - protein, 1133 aa, Artificial Sequence; identical to SEQ ID NO: 385
  Prevotella falsenii

SEQ ID NO: 515 - protein, 1133 aa, Artificial Sequence; identical to SEQ ID NO: 413
  Reichenbachiella agariperforans

SEQ ID NO: 516 - protein, 1134 aa, Artificial Sequence; identical to SEQ ID NO: 348
  Prevotella intermedia 17

SEQ ID NO: 517 - protein, 1135 aa, Artificial Sequence; identical to SEQ ID NO: 329
  Synthetic

SEQ ID NO: 518 - protein, 1135 aa, Artificial Sequence; identical to SEQ ID NO: 358
  Porphyromonas gingivalis

SEQ ID NO: 519 - protein, 1135 aa, Artificial Sequence; identical to SEQ ID NO: 359
  Porphyromonas gingivalis

SEQ ID NO: 520 - protein, 1135 aa, Artificial Sequence; identical to SEQ ID NO: 360
  Porphyromonas gingivalis

SEQ ID NO: 521 - protein, 1135 aa, Artificial Sequence; identical to SEQ ID NO: 367
  Porphyromonas gingivalis

SEQ ID NO: 522 - protein, 1135 aa, Artificial Sequence; identical to SEQ ID NO: 358
  Porphyromonas gingivalis

SEQ ID NO: 523 - protein, 1135 aa, Artificial Sequence; identical to SEQ ID NO: 381
  Porphyromonas gingivalis

SEQ ID NO: 524 - protein, 1135 aa, Artificial Sequence; identical to SEQ ID NO: 359
  Porphyromonas gingivalis

SEQ ID NO: 525 - protein, 1135 aa, Artificial Sequence; identical to SEQ ID NO: 360
  Porphyromonas gingivalis

SEQ ID NO: 526 - protein, 1135 aa, Artificial Sequence; identical to SEQ ID NO: 384
  Porphyromonas gingivalis

SEQ ID NO: 527 - protein, 1135 aa, Artificial Sequence; identical to SEQ ID NO: 394
  Porphyromonas gulae

SEQ ID NO: 528 - protein, 1135 aa, Artificial Sequence; identical to SEQ ID NO: 408
  Porphyromonas gingivalis

SEQ ID NO: 529 - protein, 1139 aa, Artificial Sequence; identical to SEQ ID NO: 379
  Prevotella pleuritidis

SEQ ID NO: 530 - protein, 1145 aa, Artificial Sequence; identical to SEQ ID NO: 377
  Psychroflexus torquis

SEQ ID NO: 531 - protein, 1145 aa, Artificial Sequence; identical to SEQ ID NO: 402
  Chryseobacterium sp. YR477

SEQ ID NO: 532 - protein, 1149 aa, Artificial Sequence; identical to SEQ ID NO: 412
  Sinomicrobium oceani

SEQ ID NO: 533 - protein, 1150 aa, Artificial Sequence; identical to SEQ ID NO: 342
  Flavobacterium branchiophilum

SEQ ID NO: 534 - protein, 1150 aa, Artificial Sequence; identical to SEQ ID NO: 355
  Prevotella saccharolytica

SEQ ID NO: 535 - protein, 1151 aa, Artificial Sequence; identical to SEQ ID NO: 336
  Prevotella saccharolytica

SEQ ID NO: 536 - protein, 1154 aa, Artificial Sequence; identical to SEQ ID NO: 374
  Paludibacter propionicigenes

SEQ ID NO: 537 - protein, 1155 aa, Artificial Sequence; identical to SEQ ID NO: 400
  Flavobacterium sp. 316

SEQ ID NO: 538 - protein, 1156 aa, Artificial Sequence; identical to SEQ ID NO: 364
  Chryseobacterium carnipullorum

SEQ ID NO: 539 - protein, 1157 aa, Artificial Sequence; identical to SEQ ID NO: 352
  Myroides odoratimimus

SEQ ID NO: 540 - protein, 1157 aa, Artificial Sequence; identical to SEQ ID NO: 353
  Myroides odoratimimus

SEQ ID NO: 541 - protein, 1157 aa, Artificial Sequence; identical to SEQ ID NO: 352
  Myroides odoratimimus

SEQ ID NO: 542 - protein, 1157 aa, Artificial Sequence; identical to SEQ ID NO: 353
  Myroides odoratimimus

SEQ ID NO: 543 - protein, 1159 aa, Artificial Sequence; identical to SEQ ID NO: 337
  Synthetic

SEQ ID NO: 544 - protein, 1159 aa, Artificial Sequence; identical to SEQ ID NO: 343
  Unknown

SEQ ID NO: 545 - protein, 1161 aa, Artificial Sequence; identical to SEQ ID NO: 362
  Bacteroidetes bacterium GWA2_31_9

SEQ ID NO: 546 - protein, 1165 aa, Artificial Sequence; identical to SEQ ID NO: 363
  Chryseobacterium jejuense

SEQ ID NO: 547 - protein, 1174 aa, Artificial Sequence; identical to SEQ ID NO: 393
  Porphyromonas gulae

SEQ ID NO: 548 - protein, 1175 aa, Artificial Sequence; identical to SEQ ID NO: 340
  Porphyromonas gulae

SEQ ID NO: 549 - protein, 1175 aa, Artificial Sequence; identical to SEQ ID NO: 346
  Unknown

SEQ ID NO: 550 - protein, 1175 aa, Artificial Sequence; identical to SEQ ID NO: 356
  Porphyromonas gingivalis JCVISC001

SEQ ID NO: 551 - protein, 1175 aa, Artificial Sequence; identical to SEQ ID NO: 368
  Porphyromonas gingivalis

SEQ ID NO: 552 - protein, 1175 aa, Artificial Sequence; identical to SEQ ID NO: 388
  Porphyromonas gulae

SEQ ID NO: 553 - protein, 1175 aa, Artificial Sequence; identical to SEQ ID NO: 391
  Porphyromonas gulae

SEQ ID NO: 554 - protein, 1175 aa, Artificial Sequence; identical to SEQ ID NO: 401
  Porphyromonas gulae

SEQ ID NO: 555 - protein, 1175 aa, Artificial Sequence; identical to SEQ ID NO: 404
  Porphyromonas gulae

SEQ ID NO: 556 - protein, 1175 aa, Artificial Sequence; identical to SEQ ID NO: 405
  Porphyromonas gingivalis

SEQ ID NO: 557 - protein, 1179 aa, Artificial Sequence; identical to SEQ ID NO: 376
  Flavobacterium columnare

SEQ ID NO: 558 - protein, 1199 aa, Artificial Sequence; identical to SEQ ID NO: 339
  Capnocytophaga canimorsus

SEQ ID NO: 559 - protein, 1213 aa, Artificial Sequence; identical to SEQ ID NO: 406
  Flavobacterium columnare

SEQ ID NO: 560 - protein, 1213 aa, Artificial Sequence; identical to SEQ ID NO: 410
  Flavobacterium columnare

SEQ ID NO: 561 - protein, 1214 aa, Artificial Sequence; identical to SEQ ID NO: 344
  Unknown

SEQ ID NO: 562 - protein, 1218 aa, Artificial Sequence; identical to SEQ ID NO: 395
  Capnocytophaga cynodegmi

SEQ ID NO: 563 - protein, 1224 aa, Artificial Sequence; identical to SEQ ID NO: 326
  Bergeyella zoohelcum

SEQ ID NO: 564 - protein, 1224 aa, Artificial Sequence; identical to SEQ ID NO: 326
  Bergeyella zoohelcum

SEQ ID NO: 565 - protein, 1322 aa, Artificial Sequence; identical to SEQ ID NO: 332
  Prevotella sp. MA2016

SEQ ID NO: 566 - protein, 1322 aa, Artificial Sequence; identical to SEQ ID NO: 332
  Unknown

SEQ ID NO: 567 - protein, 668 aa, Artificial Sequence
  Fusobacterium necrophorum subsp. funduliforme
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 568 - protein, 796 aa, Artificial Sequence
  Tissierella sp. P1
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 569 - protein, 897 aa, Artificial Sequence
  Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 570 - protein, 919 aa, Artificial Sequence
  Cetobacterium sp, ZOR0034
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 571 - protein, 1110 aa, Artificial Sequence
  Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 572 - protein, 1110 aa, Artificial Sequence
  Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 573 - protein, 1111 aa, Artificial Sequence
  Anaerosalibacer massiliensis
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 574 - protein, 1111 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSVTERKLIEEKVAENYSLLANCPMEEVDSIKIYKIKRFLTYRSNMLLYFASINSFLCEGIKGKENETEEIWHLKDNDVRKEKVKENFKNKLIQSTENYNSSLKNQIEEKEKLLRKESKKGAFYRTIIKKLQQERIKELSEKSLTEDCEKIIKLYSKLRHSLMHYDYQYFENLFENKETPELKDKLDLHLFKSLPLIRKMKLNNKVNYLEDGDTLFVLQKTKKAKTLYQIYDALCEQKNGFNKFINDFFVSDGEENTVFKQIINEKFQSEMEFLGKRISESEEKNPKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKMAFGFLFCEFDGNISRFKDEFDASNQEKIIQYHKNGEKYLTYFLKEEEKEKFNLKKLQETIQKTGKENWLLPQNKNNLFKFYLLTYLLLPYELKGDFLGFVKKHYYDIKNVDFMDENQSSKIIESKEDDFYHKIRLFEKNTKKYEIVKYSIVPDEKLKQYFKDLGIDTKYLILEQKSEVSGEKNKKVSLKNNGMFNKTILLFVFKYYQIAFKLFNDIELYSLFFLREKSGKPFEVFLKELKDKMIGKQLNFGQLLYVIYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLGKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLMIEKNTLKISSNGKIISLVPHYSYSIDVKY

SEQ ID NO: 575 - protein, 1115 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 576 - protein, 1121 aa, Artificial Sequence
  Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 577 - protein, 1137 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 578 - protein, 1158 aa, Artificial Sequence
  Fusobacterium varium
MENKNKPNRGSIVRIIISNYDMKGIKELKVRYRKQAQLDTFILQTTLDKSNNSILINDFRVKAREKYRYSFTYDGKEKFSVPSNSIIVTKIDNAAPEKSKEIRKYKITLGIDEKCKTGSMITAAIEDLLEDDRVREGIRNPRRKASKTERKLITESICHNYAQITQCPVEEIDAVKIYKVKRFLSYRSNMLLFFALINDFLCKNLKNEKGEKINEIWEMENKGNNKKIDFDENYNILVAQIKEYFTKEIENYNNRIDNIIDKKELLKYSEEKEESEKNKKLEELNKLESQKLKILTDEEIKADVIKIIKIFSDLRHSLMHYEYKYFENLFENKKNEELAELLNLNLFKNLTLLRQMKIENKTNYLEGDEKFNILGKDVRAKNALGHYDLLVEQKNGFNNFINSFFVQDGTENLEFKKFIDENFIKAQKELEEDIKNCKESVKKLEKKLKENPKKSEDLEKKLEKKQKKLKELKKELEKMKQHYKRLNCAYVWDIHSSTVYKKLYNERKNLIEKYNKQLNGLQDKNAITGINAQLLRIKKEMEEITKSNSLFRLKYKMQIAYAFLEMEYEGNIAKFKNEFDCSKTEKIQEWLEKSEEYLNYCMEKEEDGKNYKFHFKEISEIKDTHNEEWLENTSENNLFKFYILTYLLLPMEFKGDFLGVVKKHYYDIKNVDFTDESEKELSQEQIDKMIGDSFFHKIRLFEKNTKRYEIIKYSILTSDEIKKYFELLELKVPYLEYKGIDEIGIFNKNIILPIFKYYQIIFRLYNDLEIHGLFNVSFDINKILSDLKSYGNENINFREFLYVIKQNNNSSTEEEYQKIWEKLESKYLKEPLLTPEKKEINKKTEKELKKLDGISFLRNKISHLEYEKIIEGVLKTAVNGENKKTSETNADKVFLNEKIKKIINFIKENELDKIELGFNFINDFFMKKEQFMFGQIKQVKEGNSDSITTERKRKEENNKRLKITYGLNYNNLSKIYEFSNTLREIVNSPLFLKDSTLLKKVDLSKVMLKEKPICSLQYENNTKLEDDIKRILLKDSSDIMGIYKAEVVKKLKEKLVLIFKYDEEKKIYVTVYDTSKAVPENISKEILVKRNNSKEEYFFEDNKKKYTTQYYTLEITKENELKVIPAKKLEGKEFKTEKKEENKLMLNNHYCFNVKIIY

SEQ ID NO: 579 - protein, 1385 aa, Leptotrichia sp oral taxon 879 str. F0557
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 580 - protein, 1389 aa, Leptotrichia shahii; identical to SEQ ID NO: 477

SEQ ID NO: 581 - protein, 1197 aa, Leptotrichia wadei F0279 (Lw2); identical to SEQ ID NO: 2

SEQ ID NO: 582 - protein, 1120 aa, Listeria seeligeri; identical to SEQ ID NO: 3

SEQ ID NO: 583 - protein, 1340 aa, Lachnospiraceae bacterium MA2020; identical to SEQ ID NO: 4

SEQ ID NO: 584 - protein, 1437 aa, Lachnospiraceae bacterium NK4A179; identical to SEQ ID NO: 5

SEQ ID NO: 585 - protein, 1385 aa, Clostridium aminophilum DSM 10710; identical to SEQ ID NO: 6

SEQ ID NO: 586 - protein, 1175 aa, Carnobacterium gallinarum DSM 4847; identical to SEQ ID NO: 7

SEQ ID NO: 587 - protein, 1164 aa, Carnobacterium gallinarum DSM 4847; identical to SEQ ID NO: 8

SEQ ID NO: 588 - protein, 1154 aa, Paludibacter propionicigenes WB4; identical to SEQ ID NO: 9

SEQ ID NO: 589 - protein, 970 aa, Listeria weihenstephanensis FSL R9-0317; identical to SEQ ID NO: 10

SEQ ID NO: 590 - protein, 1051 aa, Listeriaceae bacterium FSL M6-0635; identical to SEQ ID NO: 11

SEQ ID NO: 591 - protein, 1152 aa, Leptotrichia wadei F0279; identical to SEQ ID NO: 12

SEQ ID NO: 592 - protein, 1285 aa, Rhodobacter capsulatus SB1003; identical to SEQ ID NO: 13

SEQ ID NO: 593 - protein, 1285 aa, Rhodobacter capsulatus R121; identical to SEQ ID NO: 14

SEQ ID NO: 594 - protein, 1285 aa, Rhodobacter capsulatus DE442; identical to SEQ ID NO: 14

SEQ ID NO: 595 - protein, 1159 aa, Leptotrichia buccalis C-1013-b; identical to SEQ ID NO: 309

SEQ ID NO: 596 - protein, 1285 aa, Herbinix hemicellulosilytics; identical to SEQ ID NO: 310

SEQ ID NO: 597 - protein, 1344 aa, Eubacterium rectale; identical to SEQ ID NO: 311

SEQ ID NO: 598 - protein, 1373 aa, Eubacteriaceae bacterium CHKC1004; identical to SEQ ID NO: 312

SEQ ID NO: 599 - protein, 1276 aa, Blautia sp.; identical to SEQ ID NO: 319

SEQ ID NO: 600 - protein, 1385 aa, Leptotrichia sp.; identical to SEQ ID NO: 579

SEQ ID NO: 601 - protein, 1224 aa, Bergeyella zoohelcum; identical to SEQ ID NO: 326

SEQ ID NO: 602 - protein, 1126 aa, Prevotella intermedia; identical to SEQ ID NO: 327

SEQ ID NO: 603 - protein, 1127 aa, Prevotella buccae; identical to SEQ ID NO: 328

SEQ ID NO: 604 - protein, 953 aa, Alistipes sp.; identical to SEQ ID NO: 331

SEQ ID NO: 605 - protein, 1322 aa, Prevotella sp.; identical to SEQ ID NO: 332

SEQ ID NO: 606 - protein, 1095 aa, Riemerella anatipestifer; identical to SEQ ID NO: 334

SEQ ID NO: 607 - protein, 1124 aa, Prevotella aurantiaca; identical to SEQ ID NO: 335

SEQ ID NO: 608 - protein, 1151 aa, Prevotella saccharolytica; identical to SEQ ID NO: 336

SEQ ID NO: 609 - protein, 1120 aa, Prevotella intermedia; identical to SEQ ID NO: 338

SEQ ID NO: 610 - protein, 1199 aa, Capnocytophaga canimorsus; identical to SEQ ID NO: 339

SEQ ID NO: 611 - protein, 1175 aa, Porphyromonas gulae; identical to SEQ ID NO: 340

SEQ ID NO: 612 - protein, 1090 aa, Prevotella sp.; identical to SEQ ID NO: 341

SEQ ID NO: 613 - protein, 1150 aa, Flavobacterium branchiophilum; identical to SEQ ID NO: 342

SEQ ID NO: 614 - protein, 1119 aa, Porphyromonas gingivalis; identical to SEQ ID NO: 345

SEQ ID NO: 615 - protein, 1132 aa, Prevotella intermedia; identical to SEQ ID NO: 347

SEQ ID NO: 616 - protein, 1115 aa, Fusobacterium necrophorum; identical to SEQ ID NO: 575

SEQ ID NO: 617 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 618 - protein, 1110 aa, Fusobacterium necrophorum BFTR-1; identical to SEQ ID NO: 571

SEQ ID NO: 619 - protein, 668 aa, Fusobacterium necrophorum; identical to SEQ ID NO: 567

SEQ ID NO: 620 - protein, 1121 aa, Fusobacterium perfoetens; identical to SEQ ID NO: 576

SEQ ID NO: 621 - protein, 897 aa, Fusobacterium ulcerans; identical to SEQ ID NO: 569

SEQ ID NO: 622 - protein, 1111 aa, Anaerosalibacter sp.ND1; identical to SEQ ID NO: 573

SEQ ID NO: 623 - DNA, 28 bp, Artificial Sequence
  Sythetic primer
  misc_feature (1)..(1): /56-FAM
  misc_feature (9)..(9): ZEN
  misc_feature (28)..(28): /3IABkFQ/ Iowa Black Quencher
aggaaacagctatgaccatgattacgcc

SEQ ID NO: 624 - DNA, 28 bp, Artificial Sequence
  Guide RNA
ctcacgaagaaagttgtgcaaccaaaca

SEQ ID NO: 625 - DNA, 28 bp, Artificial Sequence
  Guide RNA
tcttcaatctggttggtaatggatattt

SEQ ID NO: 626 - DNA, 28 bp, Artificial Sequence
  Guide RNA
gccaatttgttagtgtcctctataaatt

SEQ ID NO: 627 - DNA, 28 bp, Artificial Sequence
  Guide RNA
tatctcacagaccctatttgattttgcc

SEQ ID NO: 628 - DNA, 28 bp, Artificial Sequence
  Guide RNA
aaattcttcattaaattcaccatttttg

SEQ ID NO: 629 - DNA, 28 bp, Artificial Sequence
  Guide RNA
tatagtttaaacataactctctcaattc

SEQ ID NO: 630 - DNA, 28 bp, Artificial Sequence
  Guide RNA
atccaaaaagcctaggatccccggtgcg

SEQ ID NO: 631 - DNA, 28 bp, Artificial Sequence
  Guide RNA
agaatgtcaagttgtattggatggttat

SEQ ID NO: 632 - DNA, 28 bp, Artificial Sequence
  Guide RNA
aaagcagccttgttgtagtcaattagtc

SEQ ID NO: 633 - DNA, 28 bp, Artificial Sequence
  Guide RNA
tgatctctttcttctttttgtcccttac

SEQ ID NO: 634 - DNA, 28 bp, Artificial Sequence
  Guide RNA
tctctttcttctttttgtcccttactat

SEQ ID NO: 635 - DNA, 28 bp, Artificial Sequence
  Guide RNA
caatcaaatgcctaggatccactgtgcg

SEQ ID NO: 636 - DNA, 28 bp, Artificial Sequence
  Spacer Sequence
gttactcttcgtagggaggtggagagct

SEQ ID NO: 637 - DNA, 28 bp, Artificial Sequence
  Spacer sequence
ctggttggtaatggatatttacaaagag

SEQ ID NO: 638 - DNA, 28 bp, Artificial Sequence
  Spacer sequence
cagaaggtttaaacagtgcctgcaaagg

SEQ ID NO: 639 - DNA, 28 bp, Artificial Sequence
  Spacer sequence
agctgtcaaatttctgccagcaagattt

SEQ ID NO: 640 - DNA, 28 bp, Artificial Sequence
  Spacer sequence
gtggtatctggtaggatttcggccctgt

SEQ ID NO: 641 - DNA, 28 bp, Artificial Sequence
  Spacer sequence
ctctctggacttgccttgacccatcgct

SEQ ID NO: 642 - DNA, 28 bp, Artificial Sequence
  Spacer sequence
agcctcacgaagaaagttgtgcaaccaa

SEQ ID NO: 643 - DNA, 28 bp, Artificial Sequence
  Spacer sequence
tcagtcgatgtcctcggccaccgacccg

SEQ ID NO: 644 - DNA, 28 bp, Artificial Sequence
  Spacer sequence
tccccttgagtctaaacctgccccccac

SEQ ID NO: 645 - DNA, 28 bp, Artificial Sequence
  Spacer sequence
ctagatttgctaaaacaaagtctgcaat

SEQ ID NO: 646 - DNA, 28 bp, Artificial Sequence
  Spacer sequence
caaaagcgacagtggaatcagcagaata

SEQ ID NO: 647 - DNA, 28 bp, Artificial Sequence
  Spacer sequence
ggaggattacacttatctctgaacccaa

SEQ ID NO: 648 - DNA, 28 bp, Artificial Sequence
  Spacer sequence
cgatgcaggaagaggttcccaaggacat

SEQ ID NO: 649 - DNA, 28 bp, Artificial Sequence
  Spacer sequence
aagtcctgctagaaagactttcatgtcc

SEQ ID NO: 650 - DNA, 28 bp, Artificial Sequence
  Spacer sequence
tattttggacaaggtttcttccttcaaa

SEQ ID NO: 651 - DNA, 28 bp, Artificial Sequence
  Spacer sequence
agtggcacaggctcccactcaggtccaa

SEQ ID NO: 652 - DNA, 28 bp, Artificial Sequence
  Spacer sequence
aatcccatccagtattcttttggagccc

SEQ ID NO: 653 - DNA, 28 bp, Artificial Sequence
  Spacer sequence
caccaagtatcaagggatcttccatgta

SEQ ID NO: 654 - DNA, 28 bp, Artificial Sequence
  Spacer sequence
atatcaaagacaccatcgttcaccttga

SEQ ID NO: 655 - DNA, 28 bp, Artificial Sequence
  Spacer sequence
gtggaggcattcatccaacattcttcta

SEQ ID NO: 656 - DNA, 28 bp, Artificial Sequence
  Spacer sequence
gagagcatgataaaagttcagccacacc

SEQ ID NO: 657 - DNA, 28 bp, Artificial Sequence
  Spacer sequence
accaagaatatcaatgaaaatttcctta

SEQ ID NO: 658 - DNA, 28 bp, Artificial Sequence
  Spacer sequence
gtgcgtaaagtccactgaaattgaaaac

SEQ ID NO: 659 - DNA, 28 bp, Artificial Sequence
  Spacer sequence
tgagcatgtagtcccacagatcctttaa

SEQ ID NO: 660 - DNA, 28 bp, Artificial Sequence
  Spacer sequence
gtcaggccctgcctaatcaacatggcag

SEQ ID NO: 661 - DNA, 28 bp, Artificial Sequence
  Spacer sequence
tcggtaagagaaccacccaaaaccaaac

SEQ ID NO: 662 - DNA, 28 bp, Artificial Sequence
  Spacer sequence
gcctctccacatttttgttcaccacctt

SEQ ID NO: 663 - DNA, 28 bp, Artificial Sequence
  Spacer sequence
cccagtgcctcagcaccatcttcagatg

SEQ ID NO: 664 - DNA, 28 bp, Artificial Sequence
  Spacer sequence
ccatgaaaaattgcctaatgtcctggtt

SEQ ID NO: 665 - DNA, 28 bp, Artificial Sequence
  Spacer sequence
atgattcaaaatacacctgttttaagaa

SEQ ID NO: 666 - DNA, 28 bp, Artificial Sequence
  Spacer sequence
ctaacaacaaattcatcaaccagactgg

SEQ ID NO: 667 - DNA, 28 bp, Artificial Sequence
  Spacer sequence
ggcaaggtcagaaaacagaacagtgtaa

SEQ ID NO: 668 - DNA, 28 bp, Artificial Sequence
  Spacer sequence
caacatgagaaatgagtgacaaggattc

SEQ ID NO: 669 - DNA, 28 bp, Artificial Sequence
  Spacer sequence
cagaggtcaaggaatttaattctgggac

SEQ ID NO: 670 - DNA, 28 bp, Artificial Sequence
  Spacer sequence
catgtcagacataaatggaagaagctga

SEQ ID NO: 671 - DNA, 28 bp, Artificial Sequence
  Spacer sequence
accgcctcacagattgaatcacttggtt

SEQ ID NO: 672 - DNA, 28 bp, Artificial Sequence
  Spacer sequence
agccttgagctctcaggctttcttgcta

SEQ ID NO: 673 - DNA, 28 bp, Artificial Sequence
  Spacer sequence
cttaagagttaggttctcactgttattc

SEQ ID NO: 674 - DNA, 28 bp, Artificial Sequence
  Spacer sequence
ggacccaaacacccaactcaaaagagtt

SEQ ID NO: 675 - DNA, 28 bp, Artificial Sequence
  Spacer sequence
tcccaaagaagaggccttaaaaggcata

SEQ ID NO: 676 - DNA, 28 bp, Artificial Sequence
  Spacer sequence
atgagactgtttgtcacaaatgtacagc

SEQ ID NO: 677 - DNA, 28 bp, Artificial Sequence
  Spacer sequence
ctcttgtcacatgatcatctgtggttag

SEQ ID NO: 678 - DNA, 28 bp, Artificial Sequence
  Spacer sequence
tacagattttccctatttttgtttctca

SEQ ID NO: 679 - DNA, 28 bp, Artificial Sequence
  Spacer sequence
gcaaaggcctataaagccagatgagata

SEQ ID NO: 680 - DNA, 28 bp, Artificial Sequence
  Spacer sequence
tgattgcttctgacagcagcttctgtgc

SEQ ID NO: 681 - DNA, 28 bp, Artificial Sequence
  Spacer sequence
agtttgttctggagtgtcttgatcaatg

SEQ ID NO: 682 - DNA, 28 bp, Artificial Sequence
  Spacer sequence
agtcatcactgatggataaaccaccttt

SEQ ID NO: 683 - DNA, 28 bp, Artificial Sequence
  Spacer sequence
ggaacatttcattcaaattcaaccagtt

SEQ ID NO: 684 - DNA, 28 bp, Artificial Sequence
  Spacer sequence
tcttcttcaagaccgaggaggtctccca

SEQ ID NO: 685 - DNA, 28 bp, Artificial Sequence
  Spacer sequence
atctctgttaaataggtctaagaaaaat

SEQ ID NO: 686 - DNA, 28 bp, Artificial Sequence
  Spacer sequence
tgagcttatgatgcagtttccttacaag

SEQ ID NO: 687 - DNA, 28 bp, Artificial Sequence
  Spacer sequence
ttaggacacagttcctcaatgagtcttt

SEQ ID NO: 688 - DNA, 28 bp, Artificial Sequence
  Spacer sequence
atccagccaatctttcacatcagtgttg

SEQ ID NO: 689 - DNA, 28 bp, Artificial Sequence
  Spacer sequence
aagggaaattggcatactttaggaggtc

SEQ ID NO: 690 - DNA, 28 bp, Artificial Sequence
  Spacer sequence
ttaactagggagactgggacgccatttg

SEQ ID NO: 691 - DNA, 28 bp, Artificial Sequence
  Spacer sequence
atctattgtttcacaaagttgatgtggc

SEQ ID NO: 692 - DNA, 28 bp, Artificial Sequence
  Spacer sequence
gcgctgcagatacaaactttgtgagaag

SEQ ID NO: 693 - DNA, 28 bp, Artificial Sequence
  Spacer sequence
tagaatctagatttaaattctgcagcga

SEQ ID NO: 694 - DNA, 28 bp, Artificial Sequence
  Spacer sequence
gctgataaatttgtttaacaagccgctc

SEQ ID NO: 695 - DNA, 28 bp, Artificial Sequence
  Spacer sequence
ggacaaggacttcctccggatcacttac

SEQ ID NO: 696 - DNA, 28 bp, Artificial Sequence
  Spacer sequence
tcaaataaagtgatctgatcatcacttg

SEQ ID NO: 697 - DNA, 28 bp, Artificial Sequence
  Spacer sequence
gccaaagataacaccaatgcagtagttg

SEQ ID NO: 698 - DNA, 28 bp, Artificial Sequence
  Spacer sequence
catagaagtcagaagcattatgcaagat

SEQ ID NO: 699 - DNA, 28 bp, Artificial Sequence
  Spacer sequence
ctggatatatgggatggcactatcccca

SEQ ID NO: 700 - DNA, 28 bp, Artificial Sequence
  Spacer sequence
tctctcagtaacagttgtttctgaaccc

SEQ ID NO: 701 - DNA, 28 bp, Artificial Sequence
  Spacer sequence
tgacatatgatttcatcattgcattcac

SEQ ID NO: 702 - DNA, 28 bp, Artificial Sequence
  Spacer sequence
agcttatgcatgtgccaagttaacaaag

SEQ ID NO: 703 - DNA, 28 bp, Artificial Sequence
  Spacer sequence
acgcacatactggtcatcacctagtttg

SEQ ID NO: 704 - DNA, 28 bp, Artificial Sequence
  Spacer sequence
acaaaaatgggcacatcattggtcccca

SEQ ID NO: 705 - DNA, 28 bp, Artificial Sequence
  Spacer sequence
tttaagaacccttcccgcacattgatag

SEQ ID NO: 706 - DNA, 28 bp, Artificial Sequence
  Spacer sequence
aaattccttatcattgtttaaacaggag

SEQ ID NO: 707 - DNA, 28 bp, Artificial Sequence
  Spacer sequence
actcaaaataatcttctattaaccttgt

SEQ ID NO: 708 - DNA, 28 bp, Artificial Sequence
  Spacer sequence
ccaatatagagttctctatttcccccaa

SEQ ID NO: 709 - DNA, 28 bp, Artificial Sequence
  Spacer sequence
aaatttcagccttccagagtcaggacct

SEQ ID NO: 710 - DNA, 28 bp, Artificial Sequence
  Spacer sequence
attcttctgagtagaagcacagattttt

SEQ ID NO: 711 - DNA, 28 bp, Artificial Sequence
  Spacer sequence
gtcaacgacagagctttactaagggact

SEQ ID NO: 712 - DNA, 28 bp, Artificial Sequence
  Spacer sequence
gattctcacgtcttcttccagtttgtcc

SEQ ID NO: 713 - DNA, 28 bp, Artificial Sequence
  Spacer sequence
cttgcctttgcatatgcctgtatttccc

SEQ ID NO: 714 - DNA, 28 bp, Artificial Sequence
  Spacer sequence
tgcaacagaatcatcttcatgcaagaaa

SEQ ID NO: 715 - DNA, 28 bp, Artificial Sequence
  Spacer sequence
ctttctacaaaggttttttgccatctca

SEQ ID NO: 716 - DNA, 28 bp, Artificial Sequence
  Spacer sequence
tgactgaggtgaaatacaaaggtgacag

SEQ ID NO: 717 - DNA, 28 bp, Artificial Sequence
  Spacer sequence
tcacagataaatttcatgtcatcattgg

SEQ ID NO: 718 - DNA, 28 bp, Artificial Sequence
  Spacer sequence
ttctactaaatggaaagatatttctgac

SEQ ID NO: 719 - DNA, 28 bp, Artificial Sequence
  Spacer sequence
ccatcttccctgttagaataagctgtaa

SEQ ID NO: 720 - DNA, 28 bp, Artificial Sequence
  Spacer sequence
gtaagtttttctccatctcctttgtcat

SEQ ID NO: 721 - DNA, 28 bp, Artificial Sequence
  Spacer sequence
ccgtgctattgtggtgttgaccttttct

SEQ ID NO: 722 - DNA, 28 bp, Artificial Sequence
  Spacer sequence
tctcttcttctccatcaaaacatatttc

SEQ ID NO: 723 - DNA, 28 bp, Artificial Sequence
  Spacer sequence
cctgtctcttctcccttggaaccgatga

SEQ ID NO: 724 - DNA, 28 bp, Artificial Sequence
  Spacer sequence
aactttatattcatagtctgagtggctc

SEQ ID NO: 725 - DNA, 28 bp, Artificial Sequence
  Spacer sequence
cgaaactctccgtaatttgactcacagc

SEQ ID NO: 726 - DNA, 28 bp, Artificial Sequence
  Spacer sequence
tcatattccagaagtcgttctccattta

SEQ ID NO: 727 - DNA, 28 bp, Artificial Sequence
  Spacer sequence
tttgttactagcaagatctaatgctgtc

SEQ ID NO: 728 - DNA, 28 bp, Artificial Sequence
  Spacer sequence
gatctaggctgtttagcttcttctctcc

SEQ ID NO: 729 - DNA, 28 bp, Artificial Sequence
  Spacer sequence
ttaaatgaagacaccattaggctaaagg

SEQ ID NO: 730 - DNA, 28 bp, Artificial Sequence
  Spacer sequence
tgtatgctgacagtcaatttctttacta

SEQ ID NO: 731 - DNA, 28 bp, Artificial Sequence
  Spacer sequence
agaacacacattcttcctcaggagtgat

SEQ ID NO: 732 - DNA, 28 bp, Artificial Sequence
  Spacer sequence
aaaccaaattgacttttgggctcaaaga

SEQ ID NO: 733 - DNA, 28 bp, Artificial Sequence
  Spacer sequence
atctgttagcctgtcaggggtctccttt

SEQ ID NO: 734 - DNA, 28 bp, Artificial Sequence
  Spacer sequence
acacattcaacataaatttaaattttgc

SEQ ID NO: 735 - DNA, 28 bp, Artificial Sequence
  Spacer sequence
gtaccaaaaatagtttttattaggaatc

SEQ ID NO: 736 - DNA, 28 bp, Artificial Sequence
  Spacer sequence
ctcagcaggtgtgatcagatcctccctc

SEQ ID NO: 737 - DNA, 28 bp, Artificial Sequence
  Spacer sequence
atgagaaatctgacactattgccatcac

SEQ ID NO: 738 - DNA, 28 bp, Artificial Sequence
  Spacer sequence
tgcttttgatttctctttgttgggttgg

SEQ ID NO: 739 - DNA, 28 bp, Artificial Sequence
  Spacer sequence
cctcagtgcaacctcaatgtcggtgaga

SEQ ID NO: 740 - DNA, 28 bp, Artificial Sequence
  Spacer sequence
atctaatccatgaaatcatgatgtctat

SEQ ID NO: 741 - DNA, 28 bp, Artificial Sequence
  Spacer sequence
gaaaaaattggtaaaaagaaccttttag

SEQ ID NO: 742 - DNA, 28 bp, Artificial Sequence
  Spacer sequence
atgaccatccgggccttgtatggagtag

SEQ ID NO: 743 - DNA, 28 bp, Artificial Sequence
  Spacer sequence
tctggtataataggtggtattcttcaga

SEQ ID NO: 744 - DNA, 28 bp, Artificial Sequence
  Spacer sequence
aacacttctttgcattctaccacttgat

SEQ ID NO: 745 - DNA, 28 bp, Artificial Sequence
  Spacer sequence
ttgccttagtctagcaactgagctagtt

SEQ ID NO: 746 - DNA, 28 bp, Artificial Sequence
  Spacer sequence
gacaaacagatgataatcttctcaggct

SEQ ID NO: 747 - DNA, 28 bp, Artificial Sequence
  Spacer sequence
gtgctgggttggaaattgtaatcttcaa

SEQ ID NO: 748 - DNA, 28 bp, Artificial Sequence
  Spacer sequence
gtgagctccaattttcataaagttctca

SEQ ID NO: 749 - DNA, 28 bp, Artificial Sequence
  Spacer sequence
attcttgctcaaggtgttcagacagtcc

SEQ ID NO: 750 - DNA, 28 bp, Artificial Sequence
  Spacer sequence
accactaacaggcatttttgaatttttg

SEQ ID NO: 751 - DNA, 28 bp, Artificial Sequence
  Spacer sequence
cctaaacaattcctcaaaagacaccttt

SEQ ID NO: 752 - DNA, 28 bp, Artificial Sequence
  Spacer sequence
tattcctcaaaagtctaatgaactcctc

SEQ ID NO: 753 - DNA, 28 bp, Artificial Sequence
  Spacer sequence
agcctatcattcacactactatagcaac

SEQ ID NO: 754 - DNA, 28 bp, Artificial Sequence
  Spacer sequence
ttttaaccctttgaatttcgactgtttt

SEQ ID NO: 755 - DNA, 28 bp, Artificial Sequence
  Spacer sequence
catccagatttaacaactgtctccttct

SEQ ID NO: 756 - DNA, 28 bp, Artificial Sequence
  Spacer sequence
ttgactttgtttaacatagagaggagcc

SEQ ID NO: 757 - DNA, 28 bp, Artificial Sequence
  Spacer sequence
acttcccctttcgtgcccatgggtctct

SEQ ID NO: 758 - DNA, 28 bp, Artificial Sequence
  Spacer sequence
gacaggattccactgcctccctgcttaa

SEQ ID NO: 759 - DNA, 28 bp, Artificial Sequence
  Spacer sequence
gcaaggttttcatagagctcagagaatt

SEQ ID NO: 760 - DNA, 28 bp, Artificial Sequence
  Spacer sequence
tactttctgaaagtttctctttaatttc

SEQ ID NO: 761 - DNA, 28 bp, Artificial Sequence
  Spacer sequence
acctgctgaaaagagagtttattccaaa

SEQ ID NO: 762 - DNA, 28 bp, Artificial Sequence
  Spacer sequence
ttggggttgatgccttcgtggcacatcc

SEQ ID NO: 763 - DNA, 28 bp, Artificial Sequence
  Spacer sequence
tgacctcgcatctttcagaattttcata

SEQ ID NO: 764 - DNA, 28 bp, Artificial Sequence
  Spacer sequence
cgatagtagtcttcagggactcacagag

SEQ ID NO: 765 - DNA, 28 bp, Artificial Sequence
  Spacer sequence
aagactttctcattttggttagaatact

SEQ ID NO: 766 - DNA, 28 bp, Artificial Sequence
  Spacer sequence
tctaaatttgaagtttgcccactctggc

SEQ ID NO: 767 - DNA, 28 bp, Artificial Sequence
  Spacer sequence
aacgaccatctactattggaactaatgt

SEQ ID NO: 768 - DNA, 28 bp, Artificial Sequence
  Spacer sequence
tccctgatgcatgccaatttgttagtgt

SEQ ID NO: 769 - DNA, 28 bp, Artificial Sequence
  Spacer sequence
actggctggagtgctcctaacaaaacac

SEQ ID NO: 770 - DNA, 28 bp, Artificial Sequence
  Spacer sequence
ctatcagcttgtaaccatcaggaatgat

SEQ ID NO: 771 - DNA, 28 bp, Artificial Sequence
  Spacer sequence
attccagactccaccaaaattgtttcca

SEQ ID NO: 772 - DNA, 28 bp, Artificial Sequence
  Spacer sequence
tgtgcagccactcttgtctgcactgtct

SEQ ID NO: 773 - DNA, 28 bp, Artificial Sequence
  Spacer sequence
acttgagtccctcaatcagaaccattct

SEQ ID NO: 774 - DNA, 28 bp, Artificial Sequence
  Spacer sequence
ttgagtttctgccttgacaacctctcat

SEQ ID NO: 775 - DNA, 28 bp, Artificial Sequence
  Spacer sequence
taactctctcaattctgagatgatttca

SEQ ID NO: 776 - DNA, 28 bp, Artificial Sequence
  Spacer sequence
ttcagcgtcttttccagacggtttttac

SEQ ID NO: 777 - DNA, 28 bp, Artificial Sequence
  Spacer sequence
caactacaaattcctttgttggttaatc

SEQ ID NO: 778 - DNA, 28 bp, Artificial Sequence
  Spacer sequence
accttttatgtgcctgtgtgttggtatt

SEQ ID NO: 779 - DNA, 28 bp, Artificial Sequence
  Spacer sequence
tgactagatatgcagatgtggaaaacat

SEQ ID NO: 780 - DNA, 28 bp, Artificial Sequence
  Spacer sequence
ggggtactcccctgcctctttatgtaat

SEQ ID NO: 781 - DNA, 28 bp, Artificial Sequence
  Spacer sequence
catgttatcggcttcctgttcgatttga

SEQ ID NO: 782 - DNA, 28 bp, Artificial Sequence
  Spacer sequence
agtaagaaccattggtgacaagccagca

SEQ ID NO: 783 - DNA, 28 bp, Artificial Sequence
  Spacer sequence
gtctttgcatgttctaggtaccaaaact

SEQ ID NO: 784 - DNA, 28 bp, Artificial Sequence
  Spacer sequence
ccccatcagatctctcaagtggttcctc

SEQ ID NO: 785 - DNA, 28 bp, Artificial Sequence
  Spacer sequence
aagaattcactgttgttttgaataagtg

SEQ ID NO: 786 - DNA, 28 bp, Artificial Sequence
  Spacer sequence
ttgaacttactcaaagcagccttgttgt

SEQ ID NO: 787 - DNA, 28 bp, Artificial Sequence
  Spacer sequence
acagaattcttcatcatgatttacattg

SEQ ID NO: 788 - DNA, 28 bp, Artificial Sequence
  Spacer sequence
cgaaacacttaagctctgcagcaagaat

SEQ ID NO: 789 - DNA, 28 bp, Artificial Sequence
  Spacer sequence
ccacctggattctccacccctgaagagt

SEQ ID NO: 790 - DNA, 28 bp, Artificial Sequence
  Spacer sequence
gcccgctagtctcctagtgaagaactta

SEQ ID NO: 791 - DNA, 28 bp, Artificial Sequence
  Spacer sequence
tcctggacatcccaaaaggacctgcata

SEQ ID NO: 792 - DNA, 28 bp, Artificial Sequence
  Spacer sequence
ctattttgtataatcaggtattggtaac

SEQ ID NO: 793 - DNA, 28 bp, Artificial Sequence
  Spacer sequence
cttgccatctgagcctgtccagccccag

SEQ ID NO: 794 - DNA, 28 bp, Artificial Sequence
  Spacer sequence
cgaaggcagttctaaacatatctaggac

SEQ ID NO: 795 - DNA, 28 bp, Artificial Sequence
  Spacer sequence
tggctctgagcactttgtgcatttgaga

SEQ ID NO: 796 - DNA, 28 bp, Artificial Sequence
  Spacer sequence
tatgccattgttgaagtcgcaggatact

SEQ ID NO: 797 - DNA, 28 bp, Artificial Sequence
  Spacer sequence
tgatactgaggtgtaggctcgaaactat

SEQ ID NO: 798 - DNA, 28 bp, Artificial Sequence
  Spacer sequence
gtctttttattgaaggcagaggtcagat

SEQ ID NO: 799 - DNA, 28 bp, Artificial Sequence
  Spacer sequence
ggaatcattggtgaaggtcaattctagt

SEQ ID NO: 800 - DNA, 28 bp, Artificial Sequence
  Spacer sequence
aatggtgggagttgttggctgaacatgc

SEQ ID NO: 801 - DNA, 28 bp, Artificial Sequence
  Spacer sequence
tgtgacatatcaaactccactgacttaa

SEQ ID NO: 802 - DNA, 28 bp, Artificial Sequence
  Spacer sequence
gtcgggtcccttaagaccgtacatgcca

SEQ ID NO: 803 - DNA, 28 bp, Artificial Sequence
  Spacer sequence
ggaaactgatcaatgcgaatatcccaca

SEQ ID NO: 804 - DNA, 28 bp, Artificial Sequence
  Spacer sequence
ttgatacccgtgatcacgataagcacaa

SEQ ID NO: 805 - DNA, 28 bp, Artificial Sequence
  Spacer sequence
atcgatgatgtgaggcagagcctcaaac

SEQ ID NO: 806 - DNA, 28 bp, Artificial Sequence
  Spacer sequence
ttctgtaggatagggcctgacacccagt

SEQ ID NO: 807 - DNA, 25 bp, Artificial Sequence
  Spacer sequence
caaaaagcctaggatccccggtgcg

SEQ ID NO: 808 - DNA, 28 bp, Artificial Sequence
  Spacer sequence
cttagagtgtcacaacatttgggcctct

SEQ ID NO: 809 - DNA, 28 bp, Artificial Sequence
  Spacer sequence
atgttgtgaacagttttcagatctggga

SEQ ID NO: 810 - DNA, 28 bp, Artificial Sequence
  Spacer sequence
aaaaatgatgcagtccatgagtgcacag

SEQ ID NO: 811 - DNA, 28 bp, Artificial Sequence
  Spacer sequence
ttttgtcccttactattccagtatgcat

SEQ ID NO: 812 - DNA, 28 bp, Artificial Sequence
  Spacer sequence
tcccacactttgtcttcatactccctcg

SEQ ID NO: 813 - DNA, 28 bp, Artificial Sequence
  Spacer sequence
atcgataagcttaatgtccttcctattc

SEQ ID NO: 814 - DNA, 28 bp, Artificial Sequence
  Spacer sequence
tgtcatcggagccttgacagcttagaac

SEQ ID NO: 815 - DNA, 28 bp, Artificial Sequence
  Spacer sequence
ataactgacgaggtcaacccgggttgcg

SEQ ID NO: 816 - DNA, 28 bp, Artificial Sequence
  Spacer sequence
catgccgtgtgagtacttggaatcttgc

SEQ ID NO: 817 - DNA, 28 bp, Artificial Sequence
  Spacer sequence
gttccctgtaaaagtgtatgaactgccc

SEQ ID NO: 818 - DNA, 28 bp, Artificial Sequence
  Spacer sequence
atttccactggatcattaaatctaccct

SEQ ID NO: 819 - DNA, 28 bp, Artificial Sequence
  Spacer sequence
gttggggtcaattcctcccatgaggtct

SEQ ID NO: 820 - DNA, 28 bp, Artificial Sequence
  Spacer sequence
agcttaagcccacctgaggtggacctgc

SEQ ID NO: 821 - DNA, 28 bp, Artificial Sequence
  Spacer sequence
gagttgactgcaggtttctcgcttgtga

SEQ ID NO: 822 - DNA, 28 bp, Artificial Sequence
  Spacer sequence
tgctctccccacaatcgatgttctacaa

SEQ ID NO: 823 - DNA, 28 bp, Artificial Sequence
  Spacer sequence
ctgaaaggcaaactttatagaggatgtt

SEQ ID NO: 824 - DNA, 28 bp, Artificial Sequence
  Spacer sequence
acttggtctgaaacaaacatgttgagtt

SEQ ID NO: 825 - DNA, 28 bp, Artificial Sequence
  Spacer sequence
cttcaagaggtcctcgctgttgcttggc

SEQ ID NO: 826 - DNA, 28 bp, Artificial Sequence
  Spacer sequence
tgttacccccatccaacagggctgcccc

SEQ ID NO: 827 - DNA, 28 bp, Artificial Sequence
  Spacer sequence
ctaaagttatagccagaaatgttgatgc

SEQ ID NO: 828 - DNA, 28 bp, Artificial Sequence
  Spacer sequence
ccccagaactgggtgcttgtctttcagc

SEQ ID NO: 829 - DNA, 28 bp, Artificial Sequence
  Spacer sequence
gatacttgactgtgtaaagcaagccaag

SEQ ID NO: 830 - DNA, 28 bp, Artificial Sequence
  Spacer sequence
tcattgagcggagtctgtgactgtttgg

SEQ ID NO: 831 - DNA, 28 bp, Artificial Sequence
  Spacer sequence
tggcattgtgccaaattgattgttcaaa

SEQ ID NO: 832 - DNA, 28 bp, Artificial Sequence
  Spacer sequence
aaactcttaccacaccacttgcaccctg

SEQ ID NO: 833 - DNA, 28 bp, Artificial Sequence
  Spacer sequence
atctgtaggatctgagatctttggtcta

SEQ ID NO: 834 - DNA, 28 bp, Artificial Sequence
  Spacer sequence
catatatacccctgaagcctggggcctt

SEQ ID NO: 835 - DNA, 28 bp, Artificial Sequence
  Spacer sequence
tcagcttctcaaggtcagccgcaagaga

SEQ ID NO: 836 - DNA, 28 bp, Artificial Sequence
  Spacer sequence
ctccccactttcaaaacattcttctttg

SEQ ID NO: 837 - DNA, 28 bp, Artificial Sequence
  Spacer sequence
agaatgtacagtctggttgagacttctg

SEQ ID NO: 838 - DNA, 28 bp, Artificial Sequence
  Spacer sequence
ctctcttttccttcctcatgatcctctg

SEQ ID NO: 839 - DNA, 28 bp, Artificial Sequence
  Spacer sequence
tccaacccattcagaaggttggttgcat

SEQ ID NO: 840 - DNA, 28 bp, Artificial Sequence
  Spacer sequence
atctgatgtgaagctctgcaattctctt

SEQ ID NO: 841 - DNA, 28 bp, Artificial Sequence
  Spacer sequence
agctcttaacttccttagacaaggacat

SEQ ID NO: 842 - DNA, 28 bp, Artificial Sequence
  Spacer sequence
agacaaatgcgcaatcaaatgcctagga

SEQ ID NO: 843 - DNA, 28 bp, Artificial Sequence
  Spacer sequence
cgcaccgaggatcctaggctttttgatg

SEQ ID NO: 844 - DNA, 28 bp, Artificial Sequence
  Spacer sequence
ttgagggactcaagttgctgtcacgctg

SEQ ID NO: 845 - DNA, 28 bp, Artificial Sequence
  Spacer sequence
gttacaagctgatagacaattctctcat

SEQ ID NO: 846 - DNA, 28 bp, Artificial Sequence
  Spacer sequence
tagtagatggtcgttgtgattatgataa

SEQ ID NO: 847 - DNA, 28 bp, Artificial Sequence
  Spacer sequence
cgcaccgaggatcctaggctttttgatg

SEQ ID NO: 848 - DNA, 28 bp, Artificial Sequence
  Spacer sequence
ttgagggactcaagttgctgtcacgctg

SEQ ID NO: 849 - DNA, 28 bp, Artificial Sequence
  Spacer sequence
gttacaagctgatagacaattctctcat

SEQ ID NO: 850 - DNA, 28 bp, Artificial Sequence
  Spacer sequence
tagtagatggtcgttgtgattatgataa

SEQ ID NO: 851 - DNA, 28 bp, Artificial Sequence
  Spacer sequence
tgaagactactatcgacaagcgctccgg

SEQ ID NO: 852 - DNA, 28 bp, Artificial Sequence
  Spacer sequence
ctcttttcagcaggtttagaagagattt

SEQ ID NO: 853 - DNA, 28 bp, Artificial Sequence
  Spacer sequence
cagtggaatcctgtcctttgatgagatt

SEQ ID NO: 854 - DNA, 28 bp, Artificial Sequence
  Spacer sequence
tgttaaatctggatgttttgtgtctttc

SEQ ID NO: 855 - DNA, 28 bp, Artificial Sequence
  Spacer sequence
gacttttgaggaatagaaaaaagtcaaa

SEQ ID NO: 856 - DNA, 28 bp, Artificial Sequence
  Spacer sequence
accttgagcaagaatgccacataccatt

SEQ ID NO: 857 - DNA, 28 bp, Artificial Sequence
  Spacer sequence
tatcatctgtttgtctggccttaacaaa

SEQ ID NO: 858 - DNA, 28 bp, Artificial Sequence
  Spacer sequence
acctattataccagaagactggagaatc

SEQ ID NO: 859 - DNA, 28 bp, Artificial Sequence
  Spacer sequence
tttcatggattagatcatgtcctgattt

SEQ ID NO: 860 - DNA, 28 bp, Artificial Sequence
  Spacer sequence
tgtcagatttctcatctacatcattaat

SEQ ID NO: 861 - DNA, 28 bp, Artificial Sequence
  Spacer sequence
ttatgttgaatgtgtcatacctgtgtca

SEQ ID NO: 862 - DNA, 28 bp, Artificial Sequence
  Spacer sequence
aagaatgtgtgttctatgagcaaatgaa

SEQ ID NO: 863 - DNA, 28 bp, Artificial Sequence
  Spacer sequence
taaacagcctagatcccatgactaactc

SEQ ID NO: 864 - DNA, 28 bp, Artificial Sequence
  Spacer sequence
ttacggagagtttcgtaagaaaacaaaa

SEQ ID NO: 865 - DNA, 28 bp, Artificial Sequence
  Spacer sequence
atggagaagaagagacaagcttcttcaa

SEQ ID NO: 866 - DNA, 28 bp, Artificial Sequence
  Spacer sequence
taacagggaagatggctcacttaagaaa

SEQ ID NO: 867 - DNA, 28 bp, Artificial Sequence
  Spacer sequence
atttcacctcagtcattaaagatcagtg

SEQ ID NO: 868 - DNA, 28 bp, Artificial Sequence
  Spacer sequence
atatgcaaaggcaaggcttgaatttcaa

SEQ ID NO: 869 - DNA, 28 bp, Artificial Sequence
  Spacer sequence
tctactcagaagaatcaccaacatcata

SEQ ID NO: 870 - DNA, 28 bp, Artificial Sequence
  Spacer sequence
aagattattttgagtctttttcaagttt

SEQ ID NO: 871 - DNA, 28 bp, Artificial Sequence
  Spacer sequence
tgtgcccatttttgttcttaatgtttct

SEQ ID NO: 872 - DNA, 28 bp, Artificial Sequence
  Spacer sequence
tgaaatcatatgtcaagtcgaagctaaa

SEQ ID NO: 873 - DNA, 28 bp, Artificial Sequence
  Spacer sequence
cttctgacttctatggtttgcttagcga

SEQ ID NO: 874 - DNA, 28 bp, Artificial Sequence
  Spacer sequence
aggaagtccttgtcctgttggaattcca

SEQ ID NO: 875 - DNA, 28 bp, Artificial Sequence
  Spacer sequence
ttgtatctgcagcgctacacaatgtcaa

SEQ ID NO: 876 - DNA, 28 bp, Artificial Sequence
  Spacer sequence
atgccaatttccctttggatccatttct

SEQ ID NO: 877 - DNA, 28 bp, Artificial Sequence
  Spacer sequence
tgcatcataagctcaaaaatggtgaatt

SEQ ID NO: 878 - DNA, 28 bp, Artificial Sequence
  Spacer sequence
tgaatgaaatgttcccattaaggatggt

SEQ ID NO: 879 - DNA, 28 bp, Artificial Sequence
  Spacer sequence
tgtcagaagcaatcaacaagtcagcttt

SEQ ID NO: 880 - DNA, 28 bp, Artificial Sequence
  Spacer sequence
atcatgtgacaagagtttgcaatcggga

SEQ ID NO: 881 - DNA, 28 bp, Artificial Sequence
  Spacer sequence
tgggtgtttgggtcctagcagaaccgac

SEQ ID NO: 882 - DNA, 28 bp, Artificial Sequence
  Spacer sequence
aatctgtgaggcggttatatcccaagat

SEQ ID NO: 883 - DNA, 28 bp, Artificial Sequence
  Spacer sequence
tcatttctcatgttgttaagtggaaaag

SEQ ID NO: 884 - DNA, 28 bp, Artificial Sequence
  Spacer sequence
tgtattttgaatcatttgttcgagaatt

SEQ ID NO: 885 - DNA, 28 bp, Artificial Sequence
  Spacer sequence
aaaatgtggagaggcctatgtttaggaa

SEQ ID NO: 886 - DNA, 28 bp, Artificial Sequence
  Spacer sequence
gggactacatgctcaactacacaaaagg

SEQ ID NO: 887 - DNA, 28 bp, Artificial Sequence
  Spacer sequence
ttttatcatgctctcacctctttaaggg

SEQ ID NO: 888 - DNA, 28 bp, Artificial Sequence
  Spacer sequence
ccttgatacttggtgattctcttgagct

SEQ ID NO: 889 - DNA, 28 bp, Artificial Sequence
  Spacer sequence
accttgtccaaaatatcattgtgaagct

SEQ ID NO: 890 - DNA, 28 bp, Artificial Sequence
  Spacer sequence
taagtgtaatcctccaggaactatgtat

SEQ ID NO: 891 - DNA, 28 bp, Artificial Sequence
  Spacer sequence
ttagactcaaggggaggtcctgcgacga

SEQ ID NO: 892 - DNA, 28 bp, Artificial Sequence
  Spacer sequence
gtgggtgtgtgtgtgtgtgtgtgtgcgt

SEQ ID NO: 893 - DNA, 28 bp, Artificial Sequence
  Spacer sequence
tgttgatatcttcaatctggttggtaat

SEQ ID NO: 894 - DNA, 28 bp, Artificial Sequence
  Spacer sequence
taaagggccaagataggtggtatctggt

SEQ ID NO: 895 - DNA, 28 bp, Artificial Sequence
  Spacer sequence
caactaaacgcctaggatccccggtgcg

SEQ ID NO: 896 - DNA, 28 bp, Artificial Sequence
  Spacer sequence
cgcaccggggatcctaggctttttggat

SEQ ID NO: 897 - DNA, 28 bp, Artificial Sequence
  Spacer sequence
tgcttatcgtgatcacgggtatcaaggc

SEQ ID NO: 898 - DNA, 28 bp, Artificial Sequence
  Spacer sequence
agtcagtggagtttgatatgtcacatct

SEQ ID NO: 899 - DNA, 28 bp, Artificial Sequence
  Spacer sequence
tgacctctgccttcaataaaaagacctt

SEQ ID NO: 900 - DNA, 28 bp, Artificial Sequence
  Spacer sequence
caaatgcacaaagtgctcagagccagtg

SEQ ID NO: 901 - DNA, 28 bp, Artificial Sequence
  Spacer sequence
accaatacctgattatacaaaatagaac

SEQ ID NO: 902 - DNA, 28 bp, Artificial Sequence
  Spacer sequence
cttcaggggtggagaatccaggtggtta

SEQ ID NO: 903 - DNA, 28 bp, Artificial Sequence
  Spacer sequence
acaaggctgctttgagtaagttcaaaga

SEQ ID NO: 904 - DNA, 28 bp, Artificial Sequence
  Spacer sequence
tttggtacctagaacatgcaaagaccgg

SEQ ID NO: 905 - DNA, 28 bp, Artificial Sequence
  Spacer sequence
acataaagaggcaggggagtacccccct

SEQ ID NO: 906 - DNA, 28 bp, Artificial Sequence
  Spacer sequence
taaccaacaaaggaatttgtagttgtgg

SEQ ID NO: 907 - DNA, 28 bp, Artificial Sequence
  Spacer sequence
cgcacagtggatcctaggcatttgattg

SEQ ID NO: 908 - DNA, 28 bp, Artificial Sequence
  Spacer sequence
tgtcattaaggatgcaaccaaccttctg

SEQ ID NO: 909 - DNA, 28 bp, Artificial Sequence
  Spacer sequence
aaagtcaacatcaaagaagaatgttttg

SEQ ID NO: 910 - DNA, 28 bp, Artificial Sequence
  Spacer sequence
aacacagcaactagaccaaagatctcag

SEQ ID NO: 911 - DNA, 28 bp, Artificial Sequence
  Spacer sequence
ggcttgtatggccaaacagtcacagact

SEQ ID NO: 912 - DNA, 28 bp, Artificial Sequence
  Spacer sequence
acagcagtccagcatcaacatttctggc

SEQ ID NO: 913 - DNA, 28 bp, Artificial Sequence
  Spacer sequence
ggccaagagaaaactcaacatgtttgtt

SEQ ID NO: 914 - DNA, 28 bp, Artificial Sequence
  Spacer sequence
aacaattgatctcacaagcgagaaacct

SEQ ID NO: 915 - DNA, 28 bp, Artificial Sequence
  Spacer sequence
gattgacattgagggtagatttaatgat

SEQ ID NO: 916 - DNA, 28 bp, Artificial Sequence
  Spacer sequence
cctcttcaatgcgcaacccgggttgacc

SEQ ID NO: 917 - DNA, 28 bp, Artificial Sequence
  Spacer sequence
cagggaagcttcgagggagtatgaagac

SEQ ID NO: 918 - DNA, 28 bp, Artificial Sequence
  Spacer sequence
caaagcaaggctcccagatctgaaaact

SEQ ID NO: 919 - DNA, 25 bp, Artificial Sequence
  T7 promoter
gaaattaatacgactcactataggg

SEQ ID NO: 920 - DNA, 400 bp, Zikv Brazil
ctcatcaatagatggggttcagtggggaaaaaagaggctatggaaataataaagaagttcaagaaagatctggctgccatgctgagaataatcaatgctaggaaggagaagaagagacggggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttggg

SEQ ID NO: 921 - DNA, 400 bp, Zikv Brazil
ctcatcaatagatggggttcagtggggaaaaaagaggctatggaaataataaagaagttcaagaaagatctggctgccatgctgagaataatcaatgctaggaaggagaagaagagacggggcgcagatactagtgtcggaattgttggcctcctgctgaccacagctatggcagcggaggtcactagacgtgggagtgcatactatatgtacttggacagaagcgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttggg

SEQ ID NO: 922 - DNA, 425 bp, T7 Promoter Zikv Brazil
gaaattaatacgactcactatagggctcatcaatagatggggttcagtggggaaaaaagaggctatggaaataataaagaagttcaagaaagatctggctgccatgctgagaataatcaatgctaggaaggagaagaagagacggggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttggg

SEQ ID NO: 923 - DNA, 425 bp, T7 Promoter Zikv Brazil
gaaattaatacgactcactatagggctcatcaatagatggggttcagtggggaaaaaagaggctatggaaataataaagaagttcaagaaagatctggctgccatgctgagaataatcaatgctaggaaggagaagaagagacggggcgcagatactagtgtcggaattgttggcctcctgctgaccacagctatggcagcggaggtcactagacgtgggagtgcatactatatgtacttggacagaagcgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttggg

SEQ ID NO: 924 - DNA, 25 bp, Artificial Sequence
  RPA primers
gaaattaatacgactcactataggg

SEQ ID NO: 925 - DNA, 45 bp, Artificial Sequence; identical to SEQ ID NO: 22
  RPA primers

SEQ ID NO: 926 - DNA, 30 bp, Artificial Sequence; identical to SEQ ID NO: 23
  RPA primers

SEQ ID NO: 927 - DNA, 59 bp, Artificial Sequence
  RPA primers
gaaattaatacgactcactatagggaacagcatattgacgctgggagagaccagagatc

SEQ ID NO: 928 - DNA, 36 bp, Artificial Sequence
  RPA primers
attcaacagcaccattccattttctggcgttctgtg

SEQ ID NO: 929 - DNA, 55 bp, Artificial Sequence
  RPA primers
gaaattaatacgactcactatagggcacaaaaacagcatattgacgctgggaaag

SEQ ID NO: 930 - DNA, 29 bp, Artificial Sequence
  RPA primers
catcttgcggcgctctgtgcctggattga

SEQ ID NO: 931 - DNA, 55 bp, Artificial Sequence
  RPA primers
gaaattaatacgactcactataggggtacaacatgatggggaaragagaraaraa

SEQ ID NO: 932 - DNA, 30 bp, Artificial Sequence
  RPA primers
  misc_feature (15)..(15): n is a, c, g, or t
cgkgtgtcccagccngckgtgtcatcwgca

SEQ ID NO: 933 - DNA, 53 bp, Artificial Sequence
  RPA primers
gaaattaatacgactcactatagggttgagcaaaccgtgctgcctgtagctcc

SEQ ID NO: 934 - DNA, 27 bp, Artificial Sequence
  RPA primers
gggaggggtctcctctaaccrctagtc

SEQ ID NO: 935 - DNA, 55 bp, Artificial Sequence
  RPA primers
gaaattaatacgactcactatagggactgtcttagacttgcatcctggagctggg

SEQ ID NO: 936 - DNA, 30 bp, Artificial Sequence
  RPA primers
cttcctccatttcagcagcgacaaccctgg

SEQ ID NO: 937 - DNA, 55 bp, Artificial Sequence
  RPA primers
gaaattaatacgactcactatagggtagagtcgaaaattggatattcaggaaccc

SEQ ID NO: 938 - DNA, 33 bp, Artificial Sequence
  RPA primers
  misc_feature (33)..(33): n is a, c, g, or t
aacccaagtcccacctgacataccttccacsdn

SEQ ID NO: 939 - DNA, 55 bp, Artificial Sequence
  RPA primers
gaaattaatacgactcactatagggtggaagagaatggagttcaactgacggtcg

SEQ ID NO: 940 - DNA, 30 bp, Artificial Sequence
  RPA primers
gaagtgcgatttcccccaagccttccagcc

SEQ ID NO: 941 - DNA, 45 bp, Artificial Sequence
  RPA primers
gaaattaatacgactcactatagggtactagtgtcggaattgttg

SEQ ID NO: 942 - DNA, 28 bp, Artificial Sequence
  RPA primers
taacacttattcatccccaatgtggttg

SEQ ID NO: 943 - DNA, 55 bp, Artificial Sequence
  RPA primers
gaaattaatacgactcactatagggttgggcctgaaaatccatacaatactccag

SEQ ID NO: 944 - DNA, 29 bp, Artificial Sequence
  RPA primers
aaaatatgcatcacccacatccagtactg

SEQ ID NO: 945 - DNA, 56 bp, Artificial Sequence
  RPA primers
gaaattaatacgactcactatagggaggatcaccagcaatattccaaagtagcatg

SEQ ID NO: 946 - DNA, 30 bp, Artificial Sequence
  RPA primers
ttgttctatgctgccctatttctaagtcag

SEQ ID NO: 947 - RNA, 36 nt, Artificial Sequence
  crRNA spacer
gauuuagacuaccccaaaaacgaaggggacuaaaac

SEQ ID NO: 948 - DNA, 25 bp, Artificial Sequence
  crRNA spacer
gaaattaatacgactcactataggg

SEQ ID NO: 949 - RNA, 28 nt, Artificial Sequence
  crRNA spacer
ugcugccugcagcccugggaucaaguac

SEQ ID NO: 950 - RNA, 28 nt, Artificial Sequence
  crRNA spacer
uggaaugaugcuguagagacagcaggau

SEQ ID NO: 951 - RNA, 28 nt, Artificial Sequence
  crRNA spacer
gaggagacagcaggaucucuggucuuuc

SEQ ID NO: 952 - RNA, 28 nt, Artificial Sequence
  crRNA spacer
uggauugauguugcagagacagcaggau

SEQ ID NO: 953 - RNA, 28 nt, Artificial Sequence
  crRNA spacer
uccuccugguaugcgacucaucucuucu

SEQ ID NO: 954 - RNA, 28 nt, Artificial Sequence
  crRNA spacer
ucccccuggaaucuuugauaugucucug

SEQ ID NO: 955 - RNA, 28 nt, Artificial Sequence
  crRNA spacer
gcccccaggccgggugccaacuucacgc

SEQ ID NO: 956 - RNA, 28 nt, Artificial Sequence
  crRNA spacer
auucucucuggaugcccaguggucuuca

SEQ ID NO: 957 - RNA, 28 nt, Artificial Sequence
  crRNA spacer
auggguugcagccucccggguuuuuaca

SEQ ID NO: 958 - RNA, 28 nt, Artificial Sequence
  crRNA spacer
ggccucccagauuuuuuacaccuucuca

SEQ ID NO: 959 - RNA, 28 nt, Artificial Sequence
  crRNA spacer
cacgguuugcagccucccaggcuuuacg

SEQ ID NO: 960 - RNA, 28 nt, Artificial Sequence
  crRNA spacer
uggcgcauggccucccugggaauuuuac

SEQ ID NO: 961 - RNA, 28 nt, Artificial Sequence
  crRNA spacer
auggguucacggacuauuucaggaagaa

SEQ ID NO: 962 - RNA, 28 nt, Artificial Sequence
  crRNA spacer
auagguucacggacuauuucaggaagaa

SEQ ID NO: 963 - RNA, 28 nt, Artificial Sequence
  crRNA spacer
augaguuuuuggcucguugagcuuccca

SEQ ID NO: 964 - RNA, 28 nt, Artificial Sequence
  crRNA spacer
auaaguuuuuggcucguugagcuuccca

SEQ ID NO: 965 - RNA, 28 nt, Artificial Sequence
  crRNA spacer
gaccacuccacaugggguuuuuuacaga

SEQ ID NO: 966 - RNA, 28 nt, Artificial Sequence
  crRNA spacer
gagcacuccacaugggguuuuuuacaga

SEQ ID NO: 967 - RNA, 28 nt, Artificial Sequence
  crRNA spacer
cguuacuguccaaguacauyuaguaugc

SEQ ID NO: 968 - RNA, 28 nt, Artificial Sequence
  crRNA spacer
cgcuacuguccaaguacauyuaguaugc

SEQ ID NO: 969 - RNA, 28 nt, Artificial Sequence
  crRNA spacer
gcaucguuucuguccaaguacauyuagu

SEQ ID NO: 970 - RNA, 28 nt, Artificial Sequence
  crRNA spacer
gcaucgcuucuguccaaguacauyuagu

SEQ ID NO: 971 - RNA, 28 nt, Artificial Sequence
  crRNA spacer
uuuuguuuauggcaaauacuggaguauu

SEQ ID NO: 972 - RNA, 28 nt, Artificial Sequence
  crRNA spacer
uucuguuuauggcaaauacuggaguauu

SEQ ID NO: 973 - RNA, 28 nt, Artificial Sequence
  crRNA spacer
uuuuacuuuuuuaacccugcgggaugug

SEQ ID NO: 974 - RNA, 28 nt, Artificial Sequence
  crRNA spacer
uuguacuuuuuuaacccugcgggaugug

SEQ ID NO: 975 - RNA, 28 nt, Artificial Sequence
  crRNA spacer
guuacugauuuuuucuuuuuuaacccug

SEQ ID NO: 976 - RNA, 28 nt, Artificial Sequence
  crRNA spacer
gucauugauuuuuucuuuuuuaacccug

SEQ ID NO: 977 - RNA, 28 nt, Artificial Sequence
  crRNA spacer
gauacauaacuaugucuggauuuuguuu

SEQ ID NO: 978 - RNA, 28 nt, Artificial Sequence
  crRNA spacer
gacacauaacuaugucuggauuuuguuu

SEQ ID NO: 979 - RNA, 28 nt, Artificial Sequence
  crRNA spacer
caugaauugauagauaacuaugucugga

SEQ ID NO: 980 - RNA, 28 nt, Artificial Sequence
  crRNA spacer
cacgaauugauagauaacuaugucugga

SEQ ID NO: 981 - RNA, 28 nt, Artificial Sequence
  crRNA spacer
auccaacauacaaaucauccauguauug

SEQ ID NO: 982 - RNA, 28 nt, Artificial Sequence
  crRNA spacer
augcaacauacaaaucauccauguauug

SEQ ID NO: 983 - DNA, 25 bp, Artificial Sequence
  Synthetic
gaaattaatacgactcactataggg

SEQ ID NO: 984 - DNA, 469 bp, Artificial Sequence
  Synthetic
gaaattaatacgactcactataggggtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcatt

SEQ ID NO: 985 - DNA, 469 bp, Artificial Sequence
  Synthetic
gaaattaatacgactcactatagggatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccac

SEQ ID NO: 986 - DNA, 490 bp, Artificial Sequence
  Synthetic
gaaattaatacgactcactatagggatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcaccta

SEQ ID NO: 987 - DNA, 469 bp, Artificial Sequence
  Synthetic
gaaattaatacgactcactatagggatggaagacagccaatgaagcagtccaagaccccaagttttgggagatggttgacgctgagcgcaagctccatcaacaggggcggtgccagtcttgtgtctataacatgatgggaaagagagagaaaaaattatctgaatttggtaaagcaaaaggaagccgtgccatctggtacatgtggctgggggcgcgtttcctcgagtttgaagctcttgggttcctgaatgaagaccactgggcatccagagagaattcaggaggaggtgttgaaggcataggactccaatatctaggctatgtaatcaaggacctatccaccaaagaagggggaggattctatgctgatgacacagcaggatgggacacacgtatcacggaagctgacctagacgatgagcaggagatcatgagctacatgaacgctgagcagaggaaactggcttg

SEQ ID NO: 988 - DNA, 498 bp, Artificial Sequence
  Synthetic
gaaattaatacgactcactatagggcactctggtaagtcaacacattcacaaaacaaaggaaaataagaaatcaaacaaggcaagaagtcaggccggattaagccatagtacggtaagagctatgctgcctgtgagccccgtctaaggacgtaaaatgaagtcaggccggaagccacggtttgagcaaaccgtgctgcctgtagctccatcgtggggatgtaaaaacccgggaggctgcaacccatggaagctgtacgcatggggtagcagactagtggttagaggagacccctcccaaaacacaacgcagcagcggggcccaacaccaggggaagctgtaccctggtggtaaggactagaggttagaggagaccccccgcacaacaataaacagcatattgacgctgggagagaccagagatcctgctgtctctacagcatcattccaggcacagaacgccagaaaatggaatggtgctgttgaatcaacaggttct

SEQ ID NO: 989 - DNA, 498 bp, Artificial Sequence
  Synthetic
gaaattaatacgactcactatagggagaggcaggagtcctgtggtagaaggcaaaactaacatgaaacaaggctagaagtcaggtcggattaagccatagtacggaaaaaactatgctacctgtgagccccgtccaaggacgttaaaagaagtcaggccattacaaatgccatagcttgagtaaactgtgcagcctgtagctccacctgagaaggtgtaaaaaatctgggaggccacaaaccatggaagctgtacgcatggcgtagtggactagcggttagaggagacccctcccttacaaatcgcagcaacaatgggggcccaaggtgagatgaagctgtagtctcactggaaggactagaggttagaggagacccccccaaaacaaaaaacagcatattgacgctgggaaagaccagagatcctgctgtctcctcagcatcattccaggcacagaacgccagaaaatggaatggtgctgttgaatcaacaggttct

SEQ ID NO: 990 - DNA, 497 bp, Artificial Sequence
  Synthetic
gaaattaatacgactcactatagggagagattcaggaaggaggaggagtcagagggagccatttggtaaaagcaggaggcaaactgtcaggccaccttaagccacagtacggaagaagctgtgcagcctgtgagccccgtccaaggacgttaaaagaagaagtcaggcccaaaagccacggtttgagcaaaccgtgctgcctgtagctccgtcgtggggacgtaaagcctgggaggctgcaaaccgtggaagctgtacgcacggtgtagcagactagtggttagaggagacccctcccatgacacaacgcagcagcggggcccgagcactgagggaagctgtacctcctgcaaaggactagaggttataggagaccccccgcaaacaaaaacagcatattgacgctgggagagaccagagatcctgctgtctcctcagcatcattccaggcacagaacgccagaaaatggaatggtgctgttgaatcaacaggttct

SEQ ID NO: 991 - DNA, 498 bp, Artificial Sequence
  Synthetic
gaaattaatacgactcactatagggatctgatcggaaaagaggaatatgtggattacatgccagccatgaaaagatacagcgctcctttcgagagtgaaggagttctgtaattgttaacaacaaacaccaaagggaccattgaagtcaggccacttgtgccacggcttgagcaaaccgtgctgcctgtagctccgccaataatgggaggcgtaaaattcccagggaggccatgcgccacggaagctgtacgcgtggcatattggactagcggttagaggagacccctcccatcactgacaaaacgcagcaaaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgccgcgagatggattggtgttgttgatccaacaggttct

SEQ ID NO: 992 - DNA, 425 bp, Artificial Sequence
  Synthetic
gaaattaatacgactcactatagggtacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcccgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgcc

SEQ ID NO: 993 - DNA, 425 bp, Artificial Sequence
  Synthetic
gaaattaatacgactcactatagggtacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcccgaaatagtccgtgaagctataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgcc

SEQ ID NO: 994 - DNA, 425 bp, Artificial Sequence
  Synthetic
gaaattaatacgactcactatagggtgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatattgtcttggaacatggaggttgtgtcaccgtaatggcacaggacaaaccgactgtc

SEQ ID NO: 995 - DNA, 425 bp, Artificial Sequence
  Synthetic
gaaattaatacgactcactatagggtgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagttatatacttggtcatgatactgctgattgccccggcatacagcatcaggtgcataggagtcagcaatagggactttgtggaaggtatgtcaggtgggacttgggttgatattgtcttggaacatggaggttgtgtcaccgtaatggcacaggacaaaccgactgtc

SEQ ID NO: 996 - DNA, 425 bp, Artificial Sequence
  Synthetic
gaaattaatacgactcactatagggtccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggggaggtccacagagattgcccgtgcctgtgaacgagctgccccacggctggaaggcttgggggaaatcgcacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaagg

SEQ ID NO: 997 - DNA, 425 bp, Artificial Sequence
  Synthetic
gaaattaatacgactcactatagggtccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggggagctccacagagattgcccgtgcctgtgaacgagctgccccacggctggaaggcttgggggaaatcgcacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaagg

SEQ ID NO: 998 - DNA, 425 bp, Artificial Sequence; identical to SEQ ID NO: 923
  Synthetic

SEQ ID NO: 999 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtaggatctgacttagaaatagggcagcatagaacaaaaatagag

SEQ ID NO: 1000 - DNA, 493 bp, Artificial Sequence; identical to SEQ ID NO: 999
  Synthetic

SEQ ID NO: 1001 - DNA, 493 bp, Artificial Sequence
  Synthetic
gaaattaatacgactcactatagggtcaaaaattgggcctgaaaatccatacaatactccagtatttgccataaagagaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtaggatctgacttagaaatagggcagcatagaacaaaaatagag

SEQ ID NO: 1002 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaacaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtaggatctgacttagaaatagggcagcatagaacaaaaatagag

SEQ ID NO: 1003 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcaatgacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtaggatctgacttagaaatagggcagcatagaacaaaaatagag

SEQ ID NO: 1004 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctgtcaatacatggatgatttgtatgtaggatctgacttagaaatagggcagcatagaacaaaaatagag

SEQ ID NO: 1005 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacgtggatgatttgtatgtaggatctgacttagaaatagggcagcatagaacaaaaatagag

SEQ ID NO: 1006 - DNA, 493 bp, Artificial Sequence
  Synthetic
gaaattaatacgactcactatagggtcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagataaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtagcatctgacttagaaatagggcagcatagaacaaaaatagag

SEQ ID NO: 1007 - RNA, 14 nt, Artificial Sequence
  Synthetic
  misc_feature (1)..(1): 56-FAM
  misc_feature (14)..(14): 3Bio
uuuuuuuuuuuuuu

SEQ ID NO: 1008 - RNA, 36 nt, Artificial Sequence; identical to SEQ ID NO: 947
  Synthetic

What is claimed is:

1. A method for detecting viruses in samples, comprising: distributing a sample or set of samples into one or more individual discrete volumes, the individual discrete volumes comprising a nucleic acid detection system comprising: a Type VI Cas effector protein having collateral cleavage activity and one or more guide RNAs capable of forming a complex with the Type VI Cas effector protein and directing sequence-specific binding of the complex to one or more corresponding virus polynucleotides in the sample or set of samples; and an RNA-based masking construct comprising a non-target RNA sequence;
incubating the sample or set of samples under conditions sufficient to allow binding of the one or more guide RNAs to one or more virus target polynucleotides;
activating the Type VI Cas effector protein via binding of the one or more guide RNAs to the one or more virus target polynucleotides, wherein activating the Type VI Cas effector protein results in collateral cleavage of the non-target RNA sequence of the RNA-based masking construct, such that a detectable signal is generated; and
detecting the detectable signal, wherein detection of the detectable signal indicates a presence of one or more viruses in the sample,
wherein, prior to incubating the sample or set of samples, the method further comprises: conducting a nuclease inactivation step and a viral inactivation step on the sample or the set of samples, wherein the sample(s) is/are a crude sample(s) and/or wherein the virus target polynucleotides are not extracted or isolated from the sample(s) after the inactivation steps, and
wherein, prior to conducting a nuclease inactivation step and a viral inactivation step on the sample or the set of samples, or prior to distributing a sample or set of samples into one or more individual discrete volumes, the method further comprises amplifying the virus target polynucleotides in the sample.

2. The method of claim 1, wherein the sample comprises two or more viruses, and wherein the method distinguishes between the two or more viruses.

3. The method of claim 1, wherein the guide RNAs detect single nucleotide variants of the one or more viruses; and wherein the guide RNAs optionally further comprise one or more synthetic mismatches.

4. The method of claim 1, wherein the one or more guide RNAs comprise a pan-viral guide RNA set that detects each virus and/or viral strain in a set of viruses; and wherein the guide RNAs are optionally derived using a set cover approach.

5. The method of claim 1, wherein the nucleic acid detection system is on a substrate, and wherein the substrate is exposed to the sample; optionally wherein the substrate is a flexible materials substrate; optionally a paper substrate, a fabric substrate, or a flexible polymer-based substrate.

6. The method of claim 5, wherein the nucleic acid detection system or a different nucleic acid detection system is applied to multiple discrete locations on the substrate.

7. The method of claim 6, wherein the different nucleic acid detection system detects a different virus at each location.

8. The method of claim 5, wherein the substrate is exposed to the sample passively, by temporarily immersing the substrate in a fluid to be sampled, by applying a fluid to be tested to the substrate, or by contacting a surface to be tested with the substrate.

9. The method of claim 8, wherein the sample is a biological or environmental sample.

10. The method of claim 9, wherein the environmental sample is obtained from a food sample, a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof.

11. The method of claim 9, wherein the biological sample is obtained from a tissue sample, saliva, blood, plasma, sera, stool, urine, sputum, mucous, lymph, synovial fluid, cerebrospinal fluid, ascites, pleural effusion, seroma, pus, or a swab of a skin or a mucosal membrane surface.

12. The method of claim 9, wherein the one or more virus target polynucleotides are not amplified from the sample prior to the inactivation steps.

13. The method of claim 1, wherein the virus is a DNA virus comprising one or more viral DNAs, wherein the nucleic acid detection system further comprises a primer that can anneal to a target nucleotide sequence of the one or more viral DNAs and wherein the primer further comprises a nucleotide sequence of an RNA polymerase promoter, such that the viral target nucleotide sequences are viral target ribonucleotide sequences generated by transcription of the viral DNAs, or such that amplifying the viral target nucleotide sequences in the sample comprises amplifying the viral DNAs via the primer, such that the amplified viral target nucleotide sequences are amplified viral target ribonucleotide sequences generated by transcription of the amplified viral DNAs.

14. The method of claim 13, wherein the DNA virus is a Myoviridae, Podoviridae, Siphoviridae, Alloherpesviridae, Herpesviridae (including human herpes virus, and Varicella Zoster virus), Malocoherpesviridae, Lipothrixviridae, Rudiviridae, Adenoviridae, Ampullaviridae, Ascoviridae, Asfarviridae, Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae, Poxviridae, Sphaerolipoviridae, Tectiviridae, Turriviridae, Dinodnavirus, Salterprovirus, Rhizidovirus, or combination thereof.

15. The method of claim 13, wherein the virus is a DNA virus comprising one or more viral DNAs, wherein amplifying the viral target nucleotide sequences in the sample comprises amplifying the viral DNAs via a primer that binds the viral DNAs and comprises a nucleotide sequence of an RNA polymerase promoter, such that the amplified viral target molecules are amplified viral target RNAs generated by transcription of the amplified viral DNAs.

16. The method of claim 1, wherein the one or more viruses is a double-stranded RNA virus, a positive sense RNA virus, a negative sense RNA virus, a retrovirus, or a combination thereof.

17. The method of claim 16, wherein the virus is a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus; optionally Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

18. The method of claim 1, wherein the sample is urine, sera, blood, or saliva.

19. The method of claim 1, wherein the sample volume required for detection is 100 µl to 1 µl.

20. The method of claim 1, wherein the virus is Zika virus.

21. The method of claim 1, wherein the RNA-based masking construct comprises an RNA oligonucleotide to which a detectable ligand and a masking component are attached.

22. The method of claim 1, wherein the nuclease inactivation step is carried out at a temperature ranging from 37° C. to 50° C. and is of a duration selected from 5 minutes, 10 minutes, 15 minutes, and 20 minutes.

23. The method of claim 1, wherein the viral inactivation step is carried out at a temperature ranging from 64° C. to 95° C. and has a duration of 5 minutes.

24. The method of claim 1, wherein the nucleic acid detection system further comprises isothermal nucleic acid amplification reagents comprising recombinase polymerase amplification (RPA) reagents, nucleic-acid sequence-based amplification (NASBA), loop-mediated isothermal amplification (LAMP) reagents, strand displacement amplification (SDA), helicase-dependent amplification (HDA), multiple displacement amplification (MDA), rolling circle amplification (RCA), ligase chain reaction (LCR), or ramification amplification (RAM).

25. The method of claim 1, wherein the virus is an RNA virus comprising one or more viral RNAs, wherein amplifying the viral target polynucleotides in the sample comprises converting the viral RNAs into viral cDNAs via a reverse transcriptase, such that amplifying the viral target polynucleotides in the sample comprises amplifying the viral cDNAs in the presence of a primer that can anneal to the viral target polynucleotides and comprises a nucleotide sequence of an RNA polymerase promoter, such that the amplified viral target polynucleotides are amplified viral target RNAs generated by transcription of the amplified viral cDNAs.

26. The method of claim 1, wherein the virus is an RNA virus comprising one or more viral RNAs, wherein amplifying the viral target molecules in the sample comprises converting the viral RNAs into viral cDNAs via reverse transcriptase and amplifying the viral cDNAs via a primer that binds the amplified viral cDNAs and comprises an RNA polymerase promoter, such that the amplified viral target molecules are amplified viral target RNAs generated by transcription of the amplified viral cDNAs.

27. A method for detecting one or more viruses in a sample, comprising:
conducting a nuclease inactivation step and a viral inactivation step on a sample, wherein the sample is a crude sample and/or wherein viral target polynucleotides are not extracted or isolated from the sample after the inactivation steps;
adding a nucleic acid detection system to the sample, the nucleic acid detection system comprising a Type VI Cas effector protein having collateral cleavage activity;
at least one guide RNA comprising a guide sequence capable of forming a complex with the Type VI Cas effector protein and directing sequence-specific binding to one or more viral target polynucleotides in the sample; and
an RNA-based masking construct comprising a non-target RNA sequence, wherein Type VI Cas effector protein collateral activity cleaves the non-target RNA sequence;
applying the sample to a lateral flow immunochromatographic assay; and
detecting a signal generated from cleavage of the non-target RNA sequence of the RNA-based masking construct, thereby detecting one or more viruses that are present in the sample,
wherein said RNA-based masking construct comprises a first and a second molecule separated by the non-target RNA sequence, wherein said lateral flow immunochromatographic assay comprises detecting said first and second molecule at discrete detection sites on a lateral flow strip, wherein uncleaved RNA-based masking construct is bound by said first molecule at a first discrete detection site if the target nucleic acid is not present in said sample, and wherein cleaved RNA-based masking construct is bound by said first molecule at the first discrete detection site and by said second molecule at a second discrete detection site if the target nucleic acid is present in said sample.

28. The method according to claim 27, wherein said first molecule and said second molecule are detected by binding to an antibody recognizing said first or second molecule and detecting said bound molecule, preferably with sandwich antibodies.

29. The method according to claim 27, wherein said lateral flow strip comprises an upstream first antibody directed against said first molecule, and a downstream second antibody directed against said second molecule, and wherein uncleaved RNA-based masking construct is bound by said first antibody if the target nucleic acid is not present in said sample, and wherein cleaved RNA-based masking construct is bound both by said first antibody and said second antibody if the target nucleic acid is present in said sample.

30. The method of claim 27, wherein, prior to conducting a nuclease inactivation step and a viral inactivation step on a sample or prior to adding a nucleic acid detection system to the sample, the method further comprises: amplifying the virus target polynucleotides in the sample.

* * * * *